US012612639B2

(12) United States Patent
Bloch et al.

(10) Patent No.: US 12,612,639 B2
(45) Date of Patent: Apr. 28, 2026

(54) GUIDED MICROBIAL REMODELING, A PLATFORM FOR THE RATIONAL IMPROVEMENT OF MICROBIAL SPECIES FOR AGRICULTURE

(71) Applicant: Pivot Bio, Inc., Minnetonka, MN (US)

(72) Inventors: Sarah Bloch, Berkeley, CA (US); Karsten Temme, Berkeley, CA (US); Alvin Tamsir, Berkeley, CA (US); Douglas Higgins, Berkeley, CA (US); Austin Davis-Richardson, Berkeley, CA (US); Rosemary Clark, Berkeley, CA (US); Shayin Gottlieb, Berkeley, CA (US)

(73) Assignee: Pivot Bio, Inc., Minnetonka, MN (US)

( * ) Notice: Subject to any disclaimer, the term of this patent is extended or adjusted under 35 U.S.C. 154(b) by 36 days.

(21) Appl. No.: 18/607,210

(22) Filed: Mar. 15, 2024

(65) Prior Publication Data

US 2025/0075222 A1 Mar. 6, 2025

Related U.S. Application Data

(63) Continuation of application No. 17/255,304, filed as application No. PCT/US2019/039528 on Jun. 27, 2019, now abandoned.

(60) Provisional application No. 62/690,619, filed on Jun. 27, 2018.

(51) Int. Cl.
*C12N 1/20* (2006.01)
*C12N 15/74* (2006.01)
*C12Q 1/6869* (2018.01)
*C12Q 1/689* (2018.01)

(52) U.S. Cl.
CPC .............. *C12N 15/74* (2013.01); *C12N 1/20* (2013.01); *C12Q 1/6869* (2013.01); *C12Q 1/689* (2013.01); *C12Q 2600/156* (2013.01)

(58) Field of Classification Search
None
See application file for complete search history.

(56) References Cited

U.S. PATENT DOCUMENTS

| | | | |
|---|---|---|---|
| 1,520,545 | A | 12/1924 | Murphy |
| 3,912,231 | A | 10/1975 | Weber |
| 4,465,017 | A | 8/1984 | Simmons |
| 4,782,022 | A | 11/1988 | Puhler et al. |
| 4,832,728 | A | 5/1989 | Allan et al. |
| 4,970,147 | A | 11/1990 | Huala et al. |
| 4,970,973 | A | 11/1990 | Lyle et al. |
| 5,071,743 | A | 12/1991 | Slilaty et al. |
| 5,116,506 | A | 5/1992 | Williamson et al. |
| 5,188,960 | A | 2/1993 | Payne et al. |
| 5,229,291 | A | 7/1993 | Nielsen et al. |
| 5,354,670 | A | 10/1994 | Nickoloff et al. |

| | | | |
|---|---|---|---|
| 5,427,785 | A | 6/1995 | Ronson et al. |
| 5,610,044 | A | 3/1997 | Lam et al. |
| 5,780,270 | A | 7/1998 | Lesley |
| 5,789,166 | A | 8/1998 | Bauer et al. |
| 5,877,012 | A | 3/1999 | Estruch et al. |
| 5,880,275 | A | 3/1999 | Fischhoff et al. |
| 5,916,029 | A | 6/1999 | Smith et al. |
| 6,033,861 | A | 3/2000 | Schafer et al. |
| 6,033,874 | A | 3/2000 | Baum et al. |
| 6,083,499 | A | 7/2000 | Narva et al. |
| 6,107,279 | A | 8/2000 | Estruch et al. |
| 6,114,148 | A | 9/2000 | Seed et al. |
| 6,127,180 | A | 10/2000 | Narva et al. |
| 6,137,033 | A | 10/2000 | Estruch et al. |
| 6,156,699 | A | 12/2000 | Johnson et al. |
| 6,218,188 | B1 | 4/2001 | Cardineau et al. |
| 6,248,535 | B1 | 6/2001 | Danenberg et al. |
| 6,326,351 | B1 | 12/2001 | Donovan et al. |
| 6,340,593 | B1 | 1/2002 | Cardineau et al. |
| 6,391,548 | B1 | 5/2002 | Bauer et al. |
| 6,399,330 | B1 | 6/2002 | Donovan et al. |
| 6,548,289 | B1 | 4/2003 | Beynon et al. |

(Continued)

FOREIGN PATENT DOCUMENTS

| | | |
|---|---|---|
| AU | 636565 B2 | 5/1993 |
| AU | 2022203325 A1 | 6/2022 |

(Continued)

OTHER PUBLICATIONS

US 8,476,226 B2, 07/2013, Lira et al. (withdrawn)
Biology 2e, OpenStax, https://openstax.org/books/biology-2e/pages/18-key-terms, [retrieved Apr. 3, 2025]). (Year: 2025).*
Sharma et al., Diversity and Evolution of Nitrogen-fixing bacteria. N. K. Singh et al. (eds.), Sustainable Agriculture Reviews 60., published 2023. (Year: 2023).*
Batista and Dixon, Manipulating nitrogen regulation in diazotrophic bacteria for agronomic benefit. Biochemical Society Transactions (2019), 47: 603-614 (Year: 2019).*
Fernandes et al., Glutamine synthetase stabilizes the binding of GlnR to nitrogen fixation gene operators. FEBS Journal (2017), 284: 903-918 (Year: 2017).*

(Continued)

*Primary Examiner* — Catherine Konopka
(74) *Attorney, Agent, or Firm* — COOLEY LLP

(57) ABSTRACT

The present disclosure provides guided microbial remodeling (GMR) methods for the rational improvement of plant-associated microbes to perform plant-beneficial functions. The GMR methods described herein allow for non-intergeneric genetic optimization of key regulatory networks within the microbes, which improve plant-beneficial functions over wild-type microbes but don't have the risks associated with transgenic approaches (e.g., unpredictable gene function, public and regulatory concerns, etc.). The present disclosure also provides remodeled microbes and compositions thereof. The utilization of remodeled microbes and compositions thereof will enable farmers to realize more productive and predictable crop yields without the nutrient degradation, leaching, or toxic runoff associated with traditional synthetically derived fertilizers.

10 Claims, 42 Drawing Sheets

Specification includes a Sequence Listing.

(56) References Cited

U.S. PATENT DOCUMENTS

| | | | |
|---|---|---|---|
| 6,548,291 B1 | 4/2003 | Narva et al. |
| 6,596,509 B1 | 7/2003 | Bauer et al. |
| 6,624,145 B1 | 9/2003 | Narva et al. |
| 6,673,610 B2 | 1/2004 | Miyawaki et al. |
| 6,713,063 B1 | 3/2004 | Malvar et al. |
| 6,713,285 B2 | 3/2004 | Bauer et al. |
| 6,773,900 B2 | 8/2004 | Short et al. |
| 6,841,358 B1 | 1/2005 | Locht et al. |
| 6,949,626 B2 | 9/2005 | Donovan et al. |
| 6,962,705 B2 | 11/2005 | Malvar et al. |
| 7,064,249 B2 | 6/2006 | Corbin et al. |
| 7,070,982 B2 | 7/2006 | Malvar et al. |
| 7,084,331 B2 | 8/2006 | Isawa et al. |
| 7,105,332 B2 | 9/2006 | Abad et al. |
| 7,132,265 B2 | 11/2006 | Bauer et al. |
| 7,244,820 B2 | 7/2007 | Miles et al. |
| 7,329,736 B2 | 2/2008 | Abad et al. |
| 7,378,499 B2 | 5/2008 | Abad et al. |
| 7,385,107 B2 | 6/2008 | Donovan et al. |
| 7,449,552 B2 | 11/2008 | Abad et al. |
| 7,462,760 B2 | 12/2008 | Abad et al. |
| 7,470,427 B2 | 12/2008 | Cocking |
| 7,476,781 B2 | 1/2009 | Abad et al. |
| 7,485,451 B2 | 2/2009 | Vandergheynst et al. |
| 7,491,698 B2 | 2/2009 | Hey et al. |
| 7,491,869 B2 | 2/2009 | Abad et al. |
| 7,504,229 B2 | 3/2009 | Donovan et al. |
| 7,615,686 B2 | 11/2009 | Miles et al. |
| 7,803,943 B2 | 9/2010 | Mao et al. |
| 7,858,849 B2 | 12/2010 | Cerf et al. |
| 7,923,602 B2 | 4/2011 | Carozzi et al. |
| 8,076,142 B2 | 12/2011 | Huang et al. |
| 8,084,416 B2 | 12/2011 | Sampson et al. |
| 8,084,418 B2 | 12/2011 | Hey et al. |
| 8,137,665 B2 | 3/2012 | Cocking |
| 8,236,757 B2 | 8/2012 | Carozzi et al. |
| 8,237,020 B2 | 8/2012 | Miles et al. |
| 8,268,584 B1 | 9/2012 | Harwood et al. |
| 8,304,604 B2 | 11/2012 | Lira et al. |
| 8,304,605 B2 | 11/2012 | Lira et al. |
| 8,319,019 B2 | 11/2012 | Abad et al. |
| 8,334,366 B1 | 12/2012 | Hughes et al. |
| 8,334,431 B2 | 12/2012 | Sampson et al. |
| 8,377,671 B2 | 2/2013 | Cournac et al. |
| 8,481,026 B1 | 7/2013 | Woodruff et al. |
| 8,513,494 B2 | 8/2013 | Wu et al. |
| 8,530,411 B2 | 9/2013 | Cerf et al. |
| 8,575,433 B2 | 11/2013 | Cerf et al. |
| 8,686,233 B2 | 4/2014 | Cerf et al. |
| 8,759,619 B2 | 6/2014 | Sampson et al. |
| 8,795,965 B2 | 8/2014 | Zhang |
| 8,802,933 B2 | 8/2014 | Abad et al. |
| 8,802,934 B2 | 8/2014 | Abad et al. |
| 9,150,851 B2 | 10/2015 | Wigley et al. |
| 9,321,697 B2 | 4/2016 | Das et al. |
| 9,487,451 B2 | 11/2016 | Doty et al. |
| 9,512,431 B2 | 12/2016 | Mirsky et al. |
| 9,657,298 B2 | 5/2017 | Soto, Sr. et al. |
| 9,796,957 B2 | 10/2017 | Barney et al. |
| 9,957,509 B2 | 5/2018 | Mirsky et al. |
| 9,975,817 B2 | 5/2018 | Temme et al. |
| 9,994,557 B2 | 6/2018 | Davidson et al. |
| 10,384,983 B2 | 8/2019 | Temme et al. |
| 10,525,318 B2 | 1/2020 | Dougherty |
| 10,556,839 B2 | 2/2020 | Temme et al. |
| 10,662,432 B2 | 5/2020 | Mirsky et al. |
| 10,919,814 B2 | 2/2021 | Temme et al. |
| 10,934,226 B2 | 3/2021 | Temme et al. |
| 10,968,446 B2 | 4/2021 | Zhao et al. |
| 11,479,516 B2 | 10/2022 | Voigt et al. |
| 11,565,979 B2 | 1/2023 | Temme et al. |
| 11,678,667 B2 | 6/2023 | Reisinger et al. |
| 11,678,668 B2 | 6/2023 | Reisinger et al. |
| 11,739,032 B2 | 8/2023 | Temme et al. |
| 11,946,162 B2 | 4/2024 | Zhao et al. |
| 11,963,530 B2 | 4/2024 | Reisinger et al. |
| 11,993,778 B2 | 5/2024 | Tamsir et al. |
| 12,151,988 B2 | 11/2024 | Tamsir et al. |
| 12,209,245 B2 | 1/2025 | Mirsky et al. |
| 12,268,212 B2 | 4/2025 | Reisinger et al. |
| 12,281,299 B2 | 4/2025 | Voigt et al. |
| 12,281,980 B2 | 4/2025 | Wood et al. |
| 12,290,074 B2 | 5/2025 | Reisinger et al. |
| 2002/0061579 A1 | 5/2002 | Farrand et al. |
| 2004/0197916 A1 | 10/2004 | Carozzi et al. |
| 2004/0197917 A1 | 10/2004 | Carozzi et al. |
| 2004/0210964 A1 | 10/2004 | Carozzi et al. |
| 2004/0210965 A1 | 10/2004 | Carozzi et al. |
| 2004/0216186 A1 | 10/2004 | Carozzi et al. |
| 2004/0235663 A1 | 11/2004 | Cocking |
| 2004/0241847 A1 | 12/2004 | Okuyama et al. |
| 2004/0250311 A1 | 12/2004 | Carozzi et al. |
| 2005/0081262 A1 | 4/2005 | Cook et al. |
| 2005/0266541 A1 | 12/2005 | Dillon |
| 2006/0033867 A1 | 2/2006 | Krisko et al. |
| 2006/0096918 A1 | 5/2006 | Semmens |
| 2006/0112447 A1 | 5/2006 | Bogdanova et al. |
| 2006/0127988 A1 | 6/2006 | Wood et al. |
| 2006/0191034 A1 | 8/2006 | Baum et al. |
| 2006/0243011 A1 | 11/2006 | Someus |
| 2007/0249018 A1 | 10/2007 | Vemuri et al. |
| 2008/0295207 A1 | 11/2008 | Baum et al. |
| 2008/0311632 A1 | 12/2008 | Figge et al. |
| 2009/0105076 A1 | 4/2009 | Stewart et al. |
| 2009/0137390 A1 | 5/2009 | Triplett |
| 2009/0144852 A1 | 6/2009 | Tomso et al. |
| 2009/0152195 A1 | 6/2009 | Rodgers et al. |
| 2009/0162477 A1 | 6/2009 | Nadel et al. |
| 2009/0258404 A1 | 10/2009 | Mikkelsen et al. |
| 2009/0308121 A1 | 12/2009 | Reddy et al. |
| 2010/0005543 A1 | 1/2010 | Sampson et al. |
| 2010/0017914 A1 | 1/2010 | Hart et al. |
| 2010/0028870 A1 | 2/2010 | Welch et al. |
| 2010/0184038 A1 | 7/2010 | Boddy et al. |
| 2010/0197592 A1 | 8/2010 | Heinrichs |
| 2010/0267147 A1 | 10/2010 | Qiao |
| 2010/0298211 A1 | 11/2010 | Carozzi et al. |
| 2011/0023184 A1 | 1/2011 | Desai et al. |
| 2011/0064710 A1 | 3/2011 | Benson et al. |
| 2011/0104690 A1 | 5/2011 | Yu et al. |
| 2011/0263488 A1 | 10/2011 | Carozzi et al. |
| 2012/0015409 A1 | 1/2012 | Tabata et al. |
| 2012/0015806 A1 | 1/2012 | Paikray et al. |
| 2012/0107889 A1 | 5/2012 | Doty et al. |
| 2012/0192605 A1 | 8/2012 | McSpadden Gardener et al. |
| 2012/0266332 A1 | 10/2012 | Kuykendall |
| 2012/0278954 A1 | 11/2012 | Bowen et al. |
| 2012/0284813 A1 | 11/2012 | Olivier et al. |
| 2012/0311745 A1 | 12/2012 | Meade et al. |
| 2012/0311746 A1 | 12/2012 | Meade et al. |
| 2012/0317681 A1 | 12/2012 | Meade et al. |
| 2012/0317682 A1 | 12/2012 | Meade et al. |
| 2012/0324605 A1 | 12/2012 | Meade et al. |
| 2012/0324606 A1 | 12/2012 | Meade et al. |
| 2012/0331589 A1 | 12/2012 | Meade et al. |
| 2012/0331590 A1 | 12/2012 | Meade et al. |
| 2013/0116170 A1 | 5/2013 | Graser et al. |
| 2013/0126428 A1 | 5/2013 | Jones et al. |
| 2013/0144827 A1 | 6/2013 | Trevino et al. |
| 2013/0167268 A1 | 6/2013 | Narva et al. |
| 2013/0167269 A1 | 6/2013 | Narva et al. |
| 2014/0011261 A1 | 1/2014 | Wang et al. |
| 2014/0155283 A1 | 6/2014 | Venkateswaran et al. |
| 2014/0182018 A1 | 6/2014 | Lang et al. |
| 2014/0196178 A1 | 7/2014 | Zaltsman |
| 2014/0223598 A1 | 8/2014 | Sampson et al. |
| 2014/0223599 A1 | 8/2014 | Sampson et al. |
| 2014/0230504 A1 | 8/2014 | Finlayson et al. |
| 2014/0273226 A1 | 9/2014 | Wu |
| 2014/0283569 A1 | 9/2014 | Doty et al. |
| 2014/0301990 A1 | 10/2014 | Gregory et al. |
| 2014/0329326 A1 | 11/2014 | Mirsky et al. |
| 2014/0336050 A1 | 11/2014 | Soto, Sr. et al. |
| 2015/0080261 A1 | 3/2015 | Wigley et al. |

(56) References Cited

U.S. PATENT DOCUMENTS

| | | |
|---|---|---|
| 2015/0101373 A1 | 4/2015 | Munusamy et al. |
| 2015/0128670 A1 | 5/2015 | Das |
| 2015/0237807 A1 | 8/2015 | Valiquette |
| 2015/0239789 A1 | 8/2015 | Kang et al. |
| 2015/0315570 A1 | 11/2015 | Zhao et al. |
| 2016/0174570 A1 | 6/2016 | Vujanovic et al. |
| 2016/0264929 A1 | 9/2016 | Barney et al. |
| 2016/0292355 A1 | 10/2016 | Lou et al. |
| 2016/0295868 A1 | 10/2016 | Jones et al. |
| 2016/0304842 A1 | 10/2016 | Donovan et al. |
| 2017/0086402 A1 | 3/2017 | Meadows-Smith et al. |
| 2017/0107160 A1 | 4/2017 | Newman et al. |
| 2017/0119690 A1 | 5/2017 | Hansen et al. |
| 2017/0152519 A1 | 6/2017 | Mirsky et al. |
| 2017/0267997 A1 | 9/2017 | Nicol et al. |
| 2017/0367349 A1 | 12/2017 | Gruver et al. |
| 2018/0002243 A1 | 1/2018 | Temme et al. |
| 2018/0020671 A1 | 1/2018 | Wigley et al. |
| 2018/0065896 A1 | 3/2018 | Van Iersel et al. |
| 2018/0073028 A1 | 3/2018 | Mirsky et al. |
| 2018/0273437 A1 | 9/2018 | Temme et al. |
| 2018/0290942 A1 | 10/2018 | Voigt et al. |
| 2018/0297905 A1 | 10/2018 | Temme et al. |
| 2018/0297906 A1 | 10/2018 | Temme et al. |
| 2019/0039964 A1 | 2/2019 | Temme et al. |
| 2019/0144352 A1 | 5/2019 | Temme et al. |
| 2019/0339964 A1 | 11/2019 | Young et al. |
| 2020/0087221 A1 | 3/2020 | Temme et al. |
| 2020/0115715 A1 | 4/2020 | Mirsky et al. |
| 2020/0299637 A1 | 9/2020 | Voigt et al. |
| 2020/0308594 A1 | 10/2020 | Tamsir et al. |
| 2020/0331820 A1 | 10/2020 | Tamsir et al. |
| 2021/0009483 A1 | 1/2021 | Temme et al. |
| 2021/0029928 A1 | 2/2021 | Gilsinger et al. |
| 2021/0163374 A1 | 6/2021 | Bloch et al. |
| 2021/0214282 A1 | 7/2021 | Temme et al. |
| 2021/0284995 A1 | 9/2021 | Zhao et al. |
| 2021/0315212 A1 | 10/2021 | Rezaei et al. |
| 2021/0345618 A1 | 11/2021 | Bloch et al. |
| 2022/0017911 A1 | 1/2022 | Temme et al. |
| 2022/0079163 A1 | 3/2022 | Reisinger et al. |
| 2022/0090095 A1 | 3/2022 | Higgins et al. |
| 2022/0106238 A1 | 4/2022 | Rezaei et al. |
| 2022/0127627 A1 | 4/2022 | Bloch et al. |
| 2022/0132861 A1 | 5/2022 | Reisinger et al. |
| 2022/0151241 A1 | 5/2022 | Reisinger et al. |
| 2022/0162544 A1 | 5/2022 | Voigt et al. |
| 2022/0211048 A1 | 7/2022 | Temme et al. |
| 2022/0282340 A1 | 9/2022 | Ryu et al. |
| 2022/0396530 A1 | 12/2022 | Tamsir et al. |
| 2022/0411344 A1 | 12/2022 | Voigt et al. |
| 2023/0019267 A1 | 1/2023 | Hapes et al. |
| 2023/0033451 A1 | 2/2023 | Reisinger et al. |
| 2023/0062568 A1 | 3/2023 | Temme et al. |
| 2023/0148607 A1 | 5/2023 | Rezaei et al. |
| 2023/0175959 A1 | 6/2023 | Wood et al. |
| 2023/0257317 A1 | 8/2023 | Temme et al. |
| 2023/0276807 A1 | 9/2023 | Reisinger et al. |
| 2023/0295559 A1 | 9/2023 | Ozaydin Eskiyenenturk et al. |
| 2024/0010576 A1 | 1/2024 | Temme et al. |
| 2024/0196903 A1 | 6/2024 | Reisinger et al. |
| 2024/0294953 A1 | 9/2024 | Eskiyenenturk et al. |
| 2024/0298647 A1 | 9/2024 | Reisinger et al. |
| 2024/0327851 A1 | 10/2024 | Tamsir et al. |
| 2024/0397955 A1 | 12/2024 | Belcher et al. |
| 2025/0027228 A1 | 1/2025 | Zhao et al. |
| 2025/0115529 A1 | 4/2025 | Tamsir et al. |
| 2025/0145544 A1 | 5/2025 | Strobel et al. |
| 2025/0185667 A1 | 6/2025 | Reisinger et al. |

FOREIGN PATENT DOCUMENTS

| | | | |
|---|---|---|---|
| CA | 2051071 A1 | 3/1993 |
| CA | 2991776 A1 | 1/2017 |
| CA | 3049258 A1 | 7/2018 |
| CN | 1289852 A | 4/2001 |
| CN | 1355293 A | 6/2002 |
| CN | 1355294 A | 6/2002 |
| CN | 1421527 A | 6/2003 |
| CN | 1500801 A | 6/2004 |
| CN | 1552846 A | 12/2004 |
| CN | 1746304 A | 3/2006 |
| CN | 101328477 A | 12/2008 |
| CN | 101880676 A | 11/2010 |
| CN | 101899430 A | 12/2010 |
| CN | 102041241 A | 5/2011 |
| CN | 102417882 A | 4/2012 |
| CN | 102690808 A | 9/2012 |
| CN | 103451130 A | 12/2013 |
| CN | 103917657 A | 7/2014 |
| CN | 104136599 A | 11/2014 |
| CN | 104204211 A | 12/2014 |
| CN | 104603260 A | 5/2015 |
| CN | 106086042 A | 11/2016 |
| CN | 107047265 A | 8/2017 |
| CN | 108220215 | 6/2018 |
| CN | 108602729 A | 9/2018 |
| CN | 110799474 A | 2/2020 |
| CN | 113268923 A | 8/2021 |
| EP | 0256889 A1 | 2/1988 |
| EP | 0292984 A2 | 11/1988 |
| EP | 0339830 A2 | 11/1989 |
| EP | 0346278 B1 | 2/1992 |
| EP | 1535913 A1 | 6/2005 |
| EP | 1645186 A2 | 4/2006 |
| EP | 2186890 A1 | 5/2010 |
| EP | 2958415 B1 | 7/2016 |
| EP | 3056569 A2 | 8/2016 |
| EP | 3231874 A1 | 10/2017 |
| EP | 3322679 A1 | 5/2018 |
| FR | 2254409 A1 | 7/1975 |
| FR | 2494297 | 5/1982 |
| FR | 2910230 A1 | 6/2008 |
| GB | 2258831 A | 2/1993 |
| JP | S63501924 A | 8/1988 |
| JP | H01225483 A | 9/1989 |
| JP | H02131581 A | 5/1990 |
| JP | H07501201 A | 2/1995 |
| JP | 2009232721 A | 10/2009 |
| JP | 2014096996 A | 5/2014 |
| JP | 2015037385 A | 2/2015 |
| JP | 2015042633 A | 3/2015 |
| JP | 2015113274 A | 6/2015 |
| JP | 2015518023 A | 6/2015 |
| JP | 2015519352 A | 7/2015 |
| JP | 2015173652 A | 10/2015 |
| JP | 2016183931 A | 10/2016 |
| JP | 2017513480 A | 6/2017 |
| RU | 94045882 A | 9/1996 |
| WO | WO-8704182 A1 | 7/1987 |
| WO | WO-9305154 A1 | 3/1993 |
| WO | WO-9320685 A1 | 10/1993 |
| WO | WO-9801088 A1 | 1/1998 |
| WO | WO-9810088 A1 | 3/1998 |
| WO | WO-9909834 A2 | 3/1999 |
| WO | WO-0057183 A1 | 9/2000 |
| WO | WO-0107567 A1 | 2/2001 |
| WO | WO-03010535 A1 | 2/2003 |
| WO | WO-03089640 A2 | 10/2003 |
| WO | WO-2004074462 A2 | 9/2004 |
| WO | WO-2005021585 A2 | 3/2005 |
| WO | WO-2005038032 A1 | 4/2005 |
| WO | WO-2006005100 A1 | 1/2006 |
| WO | WO-2006098225 A1 | 9/2006 |
| WO | WO-2006083891 A3 | 11/2006 |
| WO | WO-2006119457 A1 | 11/2006 |
| WO | WO-2007027776 A3 | 8/2007 |
| WO | WO-2009060012 A2 | 5/2009 |
| WO | WO-2009091557 A1 | 7/2009 |
| WO | WO-2010080184 A1 | 7/2010 |
| WO | WO-2010105226 A2 | 9/2010 |
| WO | WO-2010109408 A1 | 9/2010 |
| WO | WO-2011099019 A1 | 8/2011 |
| WO | WO-2011099024 A1 | 8/2011 |

(56) References Cited

FOREIGN PATENT DOCUMENTS

| WO | WO-2011103247 A2 | 8/2011 |
|----|------------------|--------|
| WO | WO-2011103248 A2 | 8/2011 |
| WO | WO-2011154960 A1 | 12/2011 |
| WO | WO-2012139004 A2 | 10/2012 |
| WO | WO-2012154651 A2 | 11/2012 |
| WO | WO-2012174271 A2 | 12/2012 |
| WO | WO-2012174646 A1 | 12/2012 |
| WO | WO-2013076687 A2 | 5/2013 |
| WO | WO-2013132518 A1 | 9/2013 |
| WO | WO-2014042517 A2 | 3/2014 |
| WO | WO-2014071182 A1 | 5/2014 |
| WO | WO-2014201044 A2 | 12/2014 |
| WO | WO-2015006675 A2 | 1/2015 |
| WO | WO-2015158403 A1 | 10/2015 |
| WO | WO-2015179825 A1 | 11/2015 |
| WO | WO-2016016629 A1 | 2/2016 |
| WO | WO-2016016630 A1 | 2/2016 |
| WO | WO-2016100727 A1 | 6/2016 |
| WO | WO-2016146955 A1 | 9/2016 |
| WO | WO-2016172655 A1 | 10/2016 |
| WO | WO-2016178580 A2 | 11/2016 |
| WO | WO-2016179046 A1 | 11/2016 |
| WO | WO-2016181228 A2 | 11/2016 |
| WO | WO-2016191828 A1 | 12/2016 |
| WO | WO-2017011602 A1 | 1/2017 |
| WO | WO-2017042833 A1 | 3/2017 |
| WO | WO-2017062412 A1 | 4/2017 |
| WO | WO-2017069717 A1 | 4/2017 |
| WO | WO-2017085235 A1 | 5/2017 |
| WO | WO-2017112422 A1 | 6/2017 |
| WO | WO-2017112827 A1 | 6/2017 |
| WO | WO-2017203440 A1 | 11/2017 |
| WO | WO-2018081543 A1 | 5/2018 |
| WO | WO-2018093331 A1 | 5/2018 |
| WO | WO-2018132774 A1 | 7/2018 |
| WO | WO-2018133774 A1 | 7/2018 |
| WO | WO-2019032926 A1 | 2/2019 |
| WO | WO-2019084059 A2 | 5/2019 |
| WO | WO-2019084342 A1 | 5/2019 |
| WO | WO-2019140125 A1 | 7/2019 |
| WO | WO-2019152704 A1 | 8/2019 |
| WO | WO-2020006064 A2 | 1/2020 |
| WO | WO-2020006246 A1 | 1/2020 |
| WO | WO-2020014498 A1 | 1/2020 |
| WO | WO-2020023630 A1 | 1/2020 |
| WO | WO-2020061363 A1 | 3/2020 |
| WO | WO-2020092940 A1 | 5/2020 |
| WO | WO-2020118111 A1 | 6/2020 |
| WO | WO-2020132632 A2 | 6/2020 |
| WO | WO-2020146372 A1 | 7/2020 |
| WO | WO-2020163251 A1 | 8/2020 |
| WO | WO-2020190363 A1 | 9/2020 |
| WO | WO-2020191201 A1 | 9/2020 |
| WO | WO-2020219893 A2 | 10/2020 |
| WO | WO-2020219932 A1 | 10/2020 |
| WO | WO-2021113352 A1 | 6/2021 |
| WO | WO-2021146209 A1 | 7/2021 |
| WO | WO-2021221689 A1 | 11/2021 |
| WO | WO-2021221690 A1 | 11/2021 |
| WO | WO-2021222567 A2 | 11/2021 |
| WO | WO-2021222643 A1 | 11/2021 |
| WO | WO-2021231449 A2 | 11/2021 |
| WO | WO-2022029661 A1 | 2/2022 |
| WO | WO-2022140656 A1 | 6/2022 |
| WO | WO-2022260676 A1 | 12/2022 |
| WO | WO-2022261433 A1 | 12/2022 |
| WO | WO-2023278804 A1 | 1/2023 |
| WO | WO-2023147050 A1 | 8/2023 |
| WO | WO-2023154805 A2 | 8/2023 |
| WO | WO-2024006524 A1 | 1/2024 |
| WO | WO-2024015230 A1 | 1/2024 |
| WO | WO-2024137259 A1 | 6/2024 |
| WO | WO-2025/024750 A2 | 1/2025 |

OTHER PUBLICATIONS

Kyle C. Grant, Engineering Rhizobacteria as Synthetic Biology Chassis. Thesis (2018), University of Oxford (Year: 2018).*

Ambrosio et al., Metabolic engineering of a diazotrophic bacterium improves ammonium release and biofertilization of plants and microalgae. Metabolic Engineering (2017), 40: 59-68 (Year: 2017).*

Ambrosio et al., Competitive fitness and stability of ammonium-excreting Azotobacter vinelandii strains in the soil. Applied Microbiology and Biotechnology (2024) 108:378 (Year: 2024).*

Huerta-Saquero et al., Regulation of transcription and activity of Rhizobium etli glutaminase A. Biochimica et Biophysica Acta (2004), 1673: 201-207 (Year: 2004).*

Interview Summary, dated Dec. 9, 2024, for U.S. Appl. No. 18/345,783, 3 pages.

Krishnan, H. B., et al., "Citrate Synthase Mutants of Sinorhizobium fredii USDA257 Form Ineffective Nodules with Aberrant Ultrastructure," Applied and Environmental Microbiology, Jun. 2003, vol. 69, No. 6, pp. 3561-3568.

Non-Final Office Action, dated Dec. 16, 2024, for U.S. Appl. No. 17/605,374, 11 pages.

Notice of Allowance, dated Dec. 17, 2024, for Chinese Patent Application No. 201880082093.3, 5 pages.

Notice of Allowance, dated Sep. 16, 2024, for U.S. Appl. No. 16/671,036, 9 pages.

Office Action for Australian Patent Application No. 2019293248 dated Dec. 19, 2024, 7 pages.

Restriction Requirement, dated Dec. 4, 2024, for U.S. Appl. No. 17/822,740, 8 pages.

Bageshwar, U. K., "Studies on Some Nitrogen Fixing Genes of Azotobacter Vinelandii," Thesis submitted to the Jamia Millia Isamia for the award of Degree of Doctor of Philosophy, Department of Biosciences, Faculty of Natural Sciences, Jamia Millia Islamia, New Delhi, Aug. 1994, 254 pages.

CAM3815164.1, Type I glutamate-ammonia ligase [Cereibacter sphaeroides], Feb. 12, 2025, 1 page, https://www.ncbi.nlm.nih.goV/protein/CAM3815164.1, retrieved Feb. 24, 2025.

CCZ99900.1 glutamine synthetase [Klebsiella variicola CAG:634], May 31, 2013, 2 pages, https://www.ncbi.nlm.nih.gOv/protein/CCZ99900.1, retrieved Feb. 27, 2025.

Cereibacter sphaeroides Taxonomy Browser, 5, pages, https://www.ncbi.nlm.nih.gov/Taxonomy/Browser/wwwtax.cgi?mode=info&id=1063, retrieved Feb. 24, 2025.

Chaurasia, A. K., et al., "Improved Eco-Friendly Recombinant *Anabaena* sp. Strain PCC7120 with Enhanced Nitrogen Biofertilizer Potential," Applied and Environmental Microbiology, Jan. 2011, vol. 77, No. 2, pp. 395-399, doi: 10.1128/AEM.01714-10.

CP009274.2, *Klebsiella variicola* strain DX120E, complete genome, Jul. 11, 2016, 3 pages, https://www.ncbi.nlm.nih.gov/nuccore/CP009274, retrieved Feb. 26, 2025, nucleotides 5430000-5433000 shown.

Farmer, R. M., et al., "Altered residues in key proteins influence the expression and activity of the nitrogenase complex in an adaptive $CO_2$ fixation-deficient mutant strain of *Rhodobacter sphaeroides*," Microbiology 2014, 160: 198-208, DOI: 10.1099/mic0.073031-0.

Fisher, S. H., et al., "Bacillus subtilis glutamine synthetase regulates its own synthesis by acting as a chaperone to stabilize GlnR-DNA complexes," PNAS, Jan. 22, 2008, vol. 105, No. 3, pp. 1014-1019.

Fisher, S. H., et al., "Feedback-Resistant Mutations in Bacillus subtilis Glutamine Synthetase Are Clustered in the Active Site," Journal of Bacteriology, Aug. 2006, vol. 188, No. 16, pp. 5966-5974, doi: 10.1128/JB.00544-06.

Fisher, S. H., et al., "Mutations in Bacillus subtilis glutamine synthetase that block its interaction with transcription factor TnrA," Molecular Microbiology 2002, 45(3), pp. 627-635.

Kegg Enzyme: 6.3.1.2, 2 pages, https://www.genome.jp/dbget-bin/www_bget?ec:6.3.1.2, retrieved Feb. 27, 2025.

Lin, L., et al., "Complete genome sequence of endophytic nitrogen-fixing Klebsiella variicola strain DX120E," Standards in Genomic Sciences (2015), 10:22, 1-7.

NCBI Taxonomy browser, 1 page, https://www.ncbi.nlm.nih.gov/Taxonomy/Browser/wwwtax.cgi?id=1898961, retrieved Feb. 26, 2025.

(56) References Cited

OTHER PUBLICATIONS

Non-Final Office Action, dated Jan. 30, 2025, for U.S. Appl. No. 17/027,030, 38 pages.

Non-Final Office Action with Office Action appendix, dated Mar. 4, 2025, for U.S. Appl. No. 17/604,119, 59 pages.

Notice of Acceptance, dated Jan. 16, 2025, for Australian Patent Application No. 2022203325, 3 pages.

Notice of Allowance, dated Dec. 13, 2024, for Ukraine Patent Application No. a201908538, with English translation, 15 pages.

Notice of Allowance, dated Jan. 30, 2025, for Korean Patent Application No. 10-2023-7036383, with English translation, 8 pages.

NZ_AGBD01001514.1, Paenibacillus riograndensis SBR5 Contig541c, whole genome shotgun sequence, Dec. 18, 2019, 3 pages, https://www.ncbi.nlm.nih.gov/nuccore/NZ_AGBD01001514.1, retrieved Feb. 26, 2025.

Office Action for Brazilian Patent Application No. BR122020010314-0 dated Feb. 11, 2025, 10 pages.

Office Action, dated Jan. 10, 2025, for Chinese Patent Application No. 202210708554.1, with English translation, 18 pages.

Office Action, dated Jan. 21, 2025, for Japanese Patent Application No. 2021- 563211, with English translation, 6 pages.

Office Action, dated Jan. 26, 2025, for Chinese Patent Application No. 202080030837.4, with English translation, 14 pages.

Office Action for Mexican Patent Application No. MX/a/2020/014295 dated Feb. 4, 2025, 28 pages.

Peralta, H., et al., "Engineering the nifH Promoter Region and Abolishing Poly-ß-Hydroxybutyrate Accumulation in Rhizobium etli Enhance Nitrogen Fixation in Symbiosis with Phaseolus vulgaris," Applied and Environmental Microbiology, Jun. 2004, vol. 70, No. 6, pp. 3272-3281.

Restriction Requirement, dated Jan. 8, 2025, for U.S. Appl. No. 17/924,916, 11 pages.

Sharma, P., et al., Diversity and Evolution of Nitrogen-fixing bacteria, Chapter 5, N.K. Singh et al. (eds.), 2023, Sustainable Agriculture Reviews 60, pp. 95-120.

Simon, H. M., et al., "Importance of cis Determinants and Nitrogenase Activity in Regulated Stability of the Klebsiella pneumoniae Nitrogenase Structural Gene mRNA," Journal of Bacteriology, Jun. 1999, vol. 181, No. 12, pp. 3751-3760.

TAH83087.1, type I glutamate-ammonia ligase [Bacillus subtilis], Feb. 24, 2019, 2 pages, https://www.ncbi.nlm.nih.goV/protein/TAH83087.1, retrieved Feb. 26, 2025.

USDA Taxon Metakosakonia intestini, 2 pages, https://acir.aphis.usda.goV/s/cird-taxon/aOu3dOOOOOOOBVJOAAO/metakosakonia-intestini, retrieved Feb. 26, 2025.

Wray, L. V., et al., "A Feedback-Resistant Mutant of Bacillus subtilis Glutamine Synthetase with Pleiotropic Defects in Nitrogen-regulated Gene Expression," Journal of Biological Chemistry, Sep. 30, 2005, vol. 280, No. 39, pp. 33298-33304.

Wray, L. V., et al., "Functional Roles of the Conserved Glu304 Loop of Bacillus subtilis Glutamine Synthetase," Journal of Bacteriology, Oct. 2010, vol. 192, No. 19, pp. 5018-5025.

40 CFR 725.3 U.S. Government Publishing Office (Jul. 1, 2010) https://www.gpo.goV/fdsys/pkg/CFR-2010-title40-vol30/pdf/CFR-2010-title40-vol30-sec725-3.pdf (Year: 2010), 3 pages.

Abd-Elhafeez, E., et al., "Isolation and Characterization of Enterobacter Strains Causing Potato Soft Rot Disease in Egypt," Minia Science Bulletin, Botany Section, Mar. 2018, 29(1), pp. 1-13.

Adhikary, H., et al. "Artificial Citrate Operon Confers Mineral Phosphate Solubilization Ability to Diverse Fluorescent Pseudomonads", Plos One, Sep. 2014, vol. 9, No. 9, p. e107554, 12 total pages.

Advisory Action, dated Jul. 9, 2024, for U.S. Appl. No. 17/278,022, 4 pages.

Aita, T.; Husimi, Y., "Adaptive walks by the fittest among finite random mutants on a Mt. Fugi-type fitness landscape," J. Theor. Biol. 193:383-405 (1998).

Alper, et al., "Tuning genetic control through promoter engineering". Proc Natl Acad Sci U S A. (Sep. 6, 2005); 102(36): 12678-12683, and erratum. Epub Aug. 25, 2005.

Altschul, S. F., et al., "Basic local alignment search tool", Journal of Molecular Biology (1990); 215(3): 403-410.

Altschul, S. F., et al., "Gapped BLAST and PSI-BLAST: a new generation of protein database search programs", Nucleic Acids Research (1997); 25(17): 3389-3402.

Ambrosio, et al. "Metabolic engineering of a diazotrophic bacterium improves ammonium release and biofertilization of plants and microalgae"; Metabolic Engineering (2017), vol. 40, pp. 59-68, DOI: 10.1016/j.ymben.2017.01.002.

An, Q., et al. "Constitutive expression of the nifA gene activates associative nitrogen fixation of Enterobacter gergoviae 57-7, an opportunistic endophytic diazotroph". Journal of Applied Microbiology, Sep. 2007, vol. 103, No. 3, pp. 613-620, doi: 10.1111/j.1365-2672.2007.03289.

Andersen, et al. Energetics of biological nitrogen fixation: determination of the ratio of formation of H2 to NH4+ catalysed by nitrogenase of Klebsiella pneumoniae in vivo. J Gen Microbiol. Nov. 1977;103(1):107-22.

Andersen et al., Herpesvirus-Mediated Gene Delivery into the Rat Brain: Specificity and Efficiency of the Neuron-Specific Enolase Promoter, Cell. Mol. Neurobiol., 13:503-15 (1993).

Anderson, J.C., et al. "BglBricks: A flexible standard for biological part assembly," Journal of Biological Engineering, 2010, 4:1, 12 pages.

Andrews et al. Use of Nitrogen Fixing Bacteria Inoculants as a Substitute for Nitrogen Fertiliser for Dryland Graminaceous Crops: Progress Made, Mechanisms of Action and Future Potential. Symbiosis 34 (2003). 21 pages.

Andrianantoandro E, et al., "Synthetic biology: new engineering rules for an emerging discipline," Mol Syst Biol 2:2006.0028, 14 pages (2006).

Aquino, B., et al., "Effect of point mutations on Herbaspirillum seropedicae NifA activity," Brazilian Journal of Medical and Biological Research, Aug. 2015, vol. 48, No. 8, pp. 683-690, doi: 10.1590/1414-431x20154522.

Arbuthnot et al. "In vitro and in vivo hepatoma cell-specific expression of a gene transferred with an adenoviral vector," Hum Gene Ther., 1996, 7(13):1503-1514.

Arnold et al., "Nucleotide sequence of a 24,206-base-pair DNA fragment carrying the entire nitrogen fixation gene cluster of Klebsiella pneumonia", J. Mol. Biol. (1988) 203, pp. 715-738.

Arriel-Elias, M.T., et al., "Shelf life enhancement of plant growth promoting rhizobacteria using a simple formulation screening method," African Journal of Microbiology Research, Feb. 7, 2018, vol. 12(5), pp. 115-126, DOI: 10.5897/AJMR2017.8787.

Arsene, F., et al., "Modulation of NifA activity by Pll in Azospirillum brasilense: Evidence for a Regulatory role of the NifA N-Terminal Domain," Journal of Bacteriology, Aug. 1996, vol. 178, No. 16, p. 4830-4838.

Austin et al. "Characterisation of the Klebsiella pneumoniae nitrogen-fixation regulatory proteins NIFA and NIFL in vitro," Eur J Biochem., 1990, 187(2):353-360.

Ausubel, et al., "Glutamine Synthetase Mutations Which Affect Expression of Nitrogen Fixation Genes in Klebsiella pneumoniae", Journal of Bacteriology, 1979, vol. 140(2), pp. 597-606.

Bageshwar, et al. An Environmentally Friendly Engineered Azotobacter Strain That Replaces a Substantial Amount of Urea Fertilizer while Sustaining the Same Wheat Yield. Appl Environ Microbial. Aug. 1, 2017; 83(15): e00590-17, 14 pages.

Bali, A. et al., "Excretion of ammonium by a nifL mutant of Azotobacter vinelandii fixing nitrogen," Appl Environ Microbiol, May 1992, vol. 58, No. 5, pp. 1711-1718.

Balota, E. L., et al., "Occurrence of Diazotrophic Bateria and Arbuscular Mycorrhizal Fungi on the Cassava Crop," Pesq. Agropec. Bras, Brasilia, v. 34, n. 7, pp. 1265-1276, Jul. 1999, English abstract only.

Barney et al., "Gene deletions resulting in increased nitrogen release by azotobacter vinelandii: application of a novel nitrogen biosensor," Applied and Environmental Microbiology, Jul. 2015, 81(13), pp. 4316-4328. Published online Apr. 17, 2015.

Barney, et al., Transcriptional analysis of an Ammonium-excreting stain of azotobacter vinelandii deregulated for nitrogen fixation. Appl. Environ. Microbiol. 2017; 83(20): 1-22.

(56) References Cited

OTHER PUBLICATIONS

Barrangou R., Exploiting CRISPR-Cas immune systems for genome editing in bacteria. Curr. Opin. Biotechnol. 2016; 37:61-68.

Bashor, C. et al. "Understanding biological regulation through synthetic biology", Annual Review of Biophysics 2018 47:1, 52 pages.

Batista et al. "Manipulating nitrogen regulation in diazotrophic bacteria for agronomic benefit," Biochemical Society Transactions 2019, vol. 47, pp. 603-614, doi: 10.1042/BST20180342.

Batzer, M. et al., "Enhanced evolutionary PCR using oligonucle-otides with inosine at the 3'-terminus," Nucleic Acid Res, vol. 19:5081-5082 (1991).

Baum, et al. "Control of coleopteran insect pests through RNA interference." Nat Biotechnol. Nov. 2007;25(11):1322-6. doi: 10.1038/nbt1359.

Bayer TS et al., "Synthesis of Methyl Halides from Biomass Using Engineered Microbes", JAm Chem Soc, (20090000), vol. 131, No. 18, pp. 6508-6515.

Becker, M., et al., "Comparative Genomics Reveal a Flagellar System, a Type VI Secretion System and Plant Growth-Promoting Gene Clusters Unique to the Endophytic Bacterium Kosakonia radicincitans," Frontiers in Microbiology, Aug. 2018, vol. 9, Art. 1997, 22 pages, doi: 10.3389/fmicb.2018.01997.

Bender, et al., "Regulatory mutations in the Klebsiella aerogenes structural gene for glutamine synthetase", Journal of Bacteriology, Oct. 1977, vol. 132, No. 1, pp. 100-105.

Bender R., "A NAC for Regulating Metabolism: the Nitrogen Assimilation Control Protein(NAC) from Klebsiella pneumoniae", J. Bacteriol., 192(19), pp. 4801-4811, Jul. 30, 2010.

Berge, O., et al., "Rahnella aquatilis, a nitrogen-fixing enteric bacterium associated with the rhizosphere of wheat and maize," Canadian Journal of Microbiology (1991), vol. 37(3) : 195-203.

Berger, B., et al., "The plant growth-promoting bacterium Kosakonia radicincitans improves fruit yield and quality of Solanum lycopersicum," J Sci Food Agric 2017, 7 pages, DOI 10.1002/jsfa.8357.

Berger, B., et al., "Successful Formulation and Application of Plant Growth-Promoting Kosakonia radicincitans in Maize Cultivation," BioMed Research International, vol. 2018, Art. 6439481, 8 pages, published Mar. 28, 2018, https://doi.org/10.1155/2018/6439481.

Beringer et al., Genetic engineering and nitrogen fixation. Biotech. Gen. Eng. Rev. 1984; 1(1):65-88.

Berninger et al., "Maintenance and Assessment of Cell Viability in Formulation of Non-Sporulating Bacterial Inoculants," Microbial Biotechnology, Mar. 2018, 11(2): 277-301.

Berrada, H,.et al., "Taxonomy of the Rhizobia: Current Perspectives," British Microbiology Research Journal, 4(6): 616-639 (2014).

Beynon J, Cannon M, Buchanan-Wollaston V, & Cannon F (1983) The nifpromoters of Klebsiella pneumoniae have a characteristic primary structure. Cell 34(2):665-671.

Bhattacharjee, R. B., et al., "Use of Nitrogen-Fixing Bacteria as Biofertiliser for non-legumes; prospects and challenges," Applied Microbiology and Biotechnology, 80:199-209 (2008).

Biggins JB, Liu, X., Feng, Z., Brady, S.F. (2011) Metabolites from the induced expression of crypic single operons found in the genome of Burkolderia pseudomallei. JACS 133:1638-1641.

Bikard et al., "The synthetic integron: an in vivo genetic shuffling device," Nucleic Acids Res., 2010, 38(15): e153, 7 pages, doi: 10.1093/nar/gkq511. Epub Jun. 9, 2010.

Bilitchenko, AI., "Eugene-a domain specific language for specifying and constraining synthetic biological parts, devices, and systems." Plos One (2011); 6.4: e18882, Apr. 29;6(4): doi: 10.1371/journal.pone.0018882. 12 pages.

Bittner, M., et al., "RpoS and RpoN are involved in the growth-dependent regulation of rfaH transcription and O antigen expression in Salmonella enterica serovar typhi," Microbial Pathogenesis 2004, vol. 36, No. 1, pp. 19-24.

Blanco, G. et al., "Sequence and molecular analysis of the nifL gene of Azotobacter vinelandii," Mol Microbiol, 9(4):869-879 (1993). doi: 10.1111/j.1365-2958.1993.tb01745.x.

Blast. Basic local alignment search tool. Available at http://blast.ncbi.nlm.nih.gov/Blast.cgi. Accessed on Oct. 10, 2023, 10 pages.

Bloch, S. E., et al., Biological nitrogen fixation in maize: optimizing nitrogenase expression in a root-associated diazotroph, Journal of Experimental Botany 2020, vol. 71, No. 15, pp. 4591-4603, doi: 10.1093/jxb/eraa176.

Bonde et al., "MODEST: a web-based design tool for oligonucleotide-mediated genome engineering and recombineering," Nucleic Acids Res., 2014, 42(W1):W408-W415.

Boris Magasanik, "Genetic Control of Nitrogen Assimilation in Bacteria," Ann. Rev. Genet 1982. 16:135-68 (Year: 1982).

Boshart et al., A very strong enhancer is located upstream of an immediate early gene of human cytomegalovirus, Cell, Jun. 1985, pp. 521-530.

Bosmans, F., et al.; "Sea anemone venom as a source of insecticidal peptides acting on voltage-gated Na+ channels," Toxicon; 49(4):550-560 (2007).

Bosworth, et al. Alfalfa yield response to inoculation with recombinant strains of Rhizobium meliloti with an extra copy of dctABD and/or modified nifA expression. Appl Environ Microbiol. Oct. 1994;60(10):3815-32.

Boyle et al. "Tools for genome-wide strain design and construction," Curr Opin Biotechnol., 2012, 23(5):666-671. doi: 10.1016/j.copbio.2012.01.012.

Brady, C., et al., "Taxonomic evaluation of the genus Enterobacter based on multilocus sequence analysis (MLSA)," Systemic and Applied Microbiology 36 (2013), pp. 309-319, https://doi.org/10.1016/j.syapm.2013.03.005.

Brandl et al., "Salmonella interactions with plants and their associated microhiota," Phytopathology, 2013, 103:316-325.

Brewin, et al., The Basis of Ammonium release in nifL Mutants of Azotobacter vinelandii. Journal of Bacteriology, Dec. 1999; 181(23): p. 7356-7362.

Buchanan-Wollaston et al., "Role of the nifA gene product in the regulation of nif expression in Klebsiella pneumoniae," Nature, vol. 294, pp. 776-778 (Dec. 1981).

Buck, M. and Cannon, W. (1987) Frameshifts close to the Klebsiella pneumoniae nifH promoter prevent multicopy inhibition by hybrid nifH plasmids. Mal Gen Genet 207(2-3):492-498.

Buckley Lab NifH database, retrieved via WayBack Machine from URL web.archive.org/web/20180110043803/https:/ /blogs.cornell . edu/buckley/nifh-sequence-database/, available on or before Jan. 10, 2018, 2 pages.

Buddrus-Schiemann, et al. Root colonization by Pseudomonas sp. DSMZ 13134 and impact on the indigenous rhizosphere bacterial community of barley. Microb Ecol. Aug. 2010;60(2):381-93. doi: 10.1007/s00248-010-9720-8. Epub Jul. 20, 2010.

Burgmann et al., Effects of model root exudates on structure and activity of a soil diazotroph community. Environmental Microbiology (2005), 7: 1711-1724 (Year: 2005).

Burris et al., "Nitrogenases," J Biol Chem., 266(15):9339-9342. (May 25, 1991).

Calcagno et al., Adaptation of the Yeast URA3 Selection System to Gram-Negative Bacteria and Generation of a AbetCDE Pseudomonas putida Strain. Applied and Environmental Microbiology (2005), 71: 883-892 (Year: 2005).

Cardinale, S., & Arkin, A.P. Contextualizing context for synthetic biology identifying causes of failure of synthetic biological systems. Biotechnol. J. 7:856-866 (2012).

Carr et al., "Enhanced multiplex genome engineering through co-operative oligonucleotide co-selection," Nucleic Acids Res., 2012, 40(17):e132, 11 pages.

CERA. "GM Crop Database. Center for Environmental Risk Assessment (CERA)", ILSI Research Foundation, at cera-gmc.org/index.php?action=gm_crop_database, 1 page (2010).

Ceranic, A., et al. "Preparation of uniformly labelled 13C- and 15N-plants using customised growth chambers," Plant Methods, vol. 16, No. 1, Apr. 6, 2020, pp. 1-15, DOI:10.1186/s13007-020-00590-9.

Chakroun, et al. "Bacterial Vegetative Insecticidal Proteins (Vip) from Entomopathogenic Bacteria." Microbial Mal Biol Rev. Mar. 2, 2016;80(2):329-50. doi: 10.1 128/MMBR.00060-15.

(56) References Cited

OTHER PUBLICATIONS

Chan et al., "Refactoring bacteriophage T7," Molecular Systems Biology, 2005, vol. 1, No. 1, pp. E1-E10, doi: 10.1038/msb4100025.

Chen, et al., "Characterization of 582 natural and synthetic terminators and quantification of their design constraints". Nat Methods. (Jul. 2013); 10(7): 659-664. Epub Jun. 2, 2013.

Chen, et al. "Expression of rat bone sialoprotein promoter in transgenic mice." J Bone Miner Res., May 1996, 11(5):654-64.

Chen, M., et al., "Complete genome sequence of Kosakonia sacchari type strain SP1T," Standards in Genomic Sciences 2014, 9:1311-1318, DOI: 10.4056/sigs.5779977.

Chen, W.-P., et al., "An automated growth enclosure for metabolic labeling of *Arabidopsis thaliana* with 13C-carbon dioxide—an in vivo labeling system for proteomics and metabolomics research," Proteome Science 2011, 9:9, 14 pages, DOI: 10.1186/1477-5956-9-9.

Chen, X., et al., Common Knowledge Evidence 1, Plant Physiology and Molecular Biology, 3rd Edition, Higher Education Press, Jun. 2007, 3rd edition, pp. 261-267, with English translation, 18 pages.

Chiang, et al. "Mutagenic oligonucleotide-directed PCR amplification (Mod-PCR): an efficient method for generating random base substitution mutations in a DNA sequence element." PCR Methods Annl. Feb. 1993;2(3):210-7. doi: 10.1101/gr.2.3.210.

Chin JW "Programming and engineering biological networks," Curr Opin Struct Biol 16: 551-556 (2006).

Choi, et al. A Tn7-based broad-range bacterial cloning and expression system. Nat Methods. Jun. 2005;2(6):443-8.

Choudhary, et al. Interactions of *Bacillus* spp. and Plants—With Special Reference to Induced Systemic Resistance (ISR). Microbiological Research. 2009, vol. 164, No. 5; pp. 493-513.

Clancy, P., et al., "The domains carrying the opposing activities in adenylyl transferase are separated by a central regulatory domain," FEBS Journal (2007), 274:2865-2877.

Cobb et al., Directed evolution: an evolving and enabling synthetic biology tool. Curr Opin Chem Biol. Aug. 2012;16(3-4):285-91, doi:10.1016/j.cbpa.2012.05.186. Epub Jun. 4, 2012.

Cohen, J.D., In vitro Tomato Fruit Cultures Demonstrate a Role for Indole-3-acetic Acid in Regulating Fruit Ripening. J. Amer. Soc. Hort. Sci. 121(3):520-524. 1996.

Colby, R.S., "Calculating Synergistic and Antagonistic Responses of Herbicide Combinations," Weeds. vol. 15, pp. 20-22 (1967).

Colebatch et al. "Symbiotic nitrogen fixation research in the postgenomics era," New Phytologist., 2002, 153(1):37-42 doi: 10.1046/j.0028-646X.2001.00304.x.

Colnaghi, R., et al., "Lethality of glnD null mutations in Azotobacter vinelandii is suppressible by prevention of glutamine synthetase adenylylation," Microbiology, May 2001; 147(Pt 5):1267-1276.

Colnaghi, R. et al., Strategies for increased ammonium production in free-living or plant associated nitrogen fixing bacteria. Plant and Soil, 1997; 194: 145-154.

Communication pursuant to Article 94(3) EPC, dated Jun. 25, 2021, for European Patent Application No. 16825147.8 (7 total pages).

Communication pursuant to Article 94(3) EPC, dated Mar. 23, 2022, for European Patent Application No. 19186353.9 (6 total pages).

Compant, S., et al., "A review on the plant microbiome: Ecology, functions, and emerging trends in microbial application," Journal of Advanced Research 19 (2019), pp. 29-37, https://doi.org/10.1016/j.jare.2019.03.004.

Conniff, R., Microbes help grow better crops. Scientific american. http://www.scientificamerican.com/article/microbes-help-grow-better-crops/ Sep. 2013, 7 pages.

Contreras, et al. The product of the nitrogen fixation regulatory gene nfrX of Azotobacter vinelandii is functionally and structurally homologous to the uridylyltransferase encoded by glnD in enteric bacteria. J Bacteriol. Dec. 1991; 173(24): 7741-7749.

Cornelis et al., "The type III secretion injectisome," Nature Reviews Mocrobilogy, 2006, 4(11):811-825.

Costerton, J. W., et al., "Microbial Biofilms," Annu. Rev. Microbiol. 1995, 49:711-745.

Crameri, et al., "Molecular evolution of an arsenate detoxification pathway by DNA shuffling." Nature Biotechnology (May 1997); 15(5): 436-438.

Crickmore, et al. "Bacillus thuringiensis toxin nomenclature," 2016, Web page, https://web.archive.org/web/20161110143346/ http://www.btnomenclature.info/, 2016, 1 page, retrieved from internet on Nov. 30, 2022.

Crickmore N, Baum J, Bravo A, Lereclus D, Narva K, Sampson K, Schnepf E, Sun M, Zeigler DR (2016) Bacillus thuringiensis toxin nomenclature, 3 pages, http://www.btnomenclature.info.

Crickmore, N., et al.; "Revision of the nomenclature for the Bacillus thuringiensis pesticidal crystal proteins," Microbiol Mol Biol Rev. (1998); 62(3):807-813.

Crook, N.C., et al., "Re-engineering multicloning sites for function and convenience," Nucl. Acids Res. 2011, vol. 39, No. 14, e92, 10 pages.

Cry1 Db2 GenBank Accession No. AAK48937 "insecticidal crystal protein [Bacillus thuringiensis]" May 1, 2001.

Cry1 Dbl GenBank Accession No. CAA80234 "crystal protein [Bacillus thuringiensis]" Apr. 18, 2005.

Cry1 Dcl GenBank Accession No. ABK35074 "insecticidal delta endotoxin [Bacillus thuringiensis]" Nov. 2, 2007.

Cry10Aa2 GenBank Accession No. E00614 "DNA encoding a polypeptide having insecticidal activity(BTI endotoxin)" Nov. 4, 2005.

Cry10Aa3 GenBank Accession No. CAD30098 "pesticidial crystal protein cry10AA (plasmid) [Bacillus thuringiensis serovar israelensis]" Oct. 23, 2008.

Cry10Aa4 GenBank Accession No. AFB18318 "putative cry10 [Bacillus thuringiensis serovar israelensis]" Feb. 21, 2012.

Cry11Aa3 GenBank Accession No. CAD30081 "pesticidial crystal protein cry11AA (plasmid) [Bacillus thuringiensis serovar israelensis]" Oct. 23, 2008.

Cry11Aa4 GenBank Accession No. AFB18319 "putative cry11A, partial [Bacillus thuringiensis serovar israelensis]" Feb. 21, 2012.

Cry11Bb2 GenBank Accession No. HM068615 "Bacillus thuringiensis strain K34 delta-endotoxin (cry11Bb2) gene, complete cds" Jul. 17, 2012.

Cry12Aal GenBank Accession No. AAA22355 "delta-endotoxin, partial [Bacillus thuringiensis]" Apr. 26, 1993.

Cry13Aal GenBank Accession No. AAA22356 "delta-endotoxin [Bacillus thuringiensis]" Apr. 26, 1993.

Cry14Aal GenBank Accession No. AAA21516 "delta endotoxin [Bacillus thuringiensis serovar sotto]" Sep. 17, 1994.

Cry14Abl GenBank Accession No. KC156652 "*Bacillus thuringiensis* strain ARP001 pesticidal protein gene, complete cds" Nov. 14, 2013.

Cry15Aal GenBank Accession No. AAA22333 "crystal protein [Bacillus thuringiensis]" Apr. 26, 1993.

Cry17Aal GenBank Accession No. CAA67841 "cbm72 mosquitocidal toxin [[Clostridium] bifermentans]" Jul. 17, 1998.

Cry18Aal GenBank Accession No. CAA67506 "parasporal crystal protein [Paenibacillus popilliae]" Apr. 18, 2005.

Cry18Cal GenBank Accession No. AAF89668 "parasporal crystal protein Cry18Ca1 [Paenibacillus popilliae ATCC 14706]" Aug. 1, 2000.

Cry19Aal GenBank Accession No. CAA68875 "mosquitocidal toxin [Bacillus thuringiensis serovar jegathesan]" Apr. 18, 2005.

Cry19Bal GenBank Accession No. BAA32397 "insecticidal protein [Bacillus thuringiensis serovar higo]" Aug. 19, 1998.

Cry19Cal GenBank Accession No. AFM37572 "crystal protein [Bacillus thuringiensis serovar vazensis]" Jun. 19, 2012.

Cry1Aa12 GenBank Accession No. AAP80146 "delta-endotoxin [Bacillus thuringiensis]" Jun. 30, 2003.

Cry1Aa13 GenBank Accession No. AAM44305 "crystal protein Cry1Aa13 [Bacillus thuringiensis serovar sotto]" Dec. 28, 2004.

Cry1Aa14 GenBank Accession No. AAP40639 "Cry1Aa [Bacillus thuringiensis]" Dec. 1, 2004.

Cry1Aa15 GenBank Accession No. AAY66993 "Cry1Aa, partial [Bacillus thuringiensis]" Jul. 26, 2016.

Cry1Aa16 GenBank Accession No. HQ439776 "*Bacillus thuringiensis* strain PS9-E2 Cry1A-like protein gene, partial cds" Jul. 25, 2016.

(56) References Cited

OTHER PUBLICATIONS

Cry1Aa17 GenBank Accession No. HQ439788 "*Bacillus thuringiensis* strain PS9-C12 Cry1A-like protein gene, partial cds" Jul. 25, 2016.
Cry1Aa18 GenBank Accession No. HQ439790 "*Bacillus thuringiensis* strain PS9-D12 Cry1A-like protein gene, partial cds" Nov. 4, 2016.
Cry1Aa19 GenBank Accession No. HQ685121 "*Bacillus thuringiensis* strain LS-R-21 Cry1Aa gene, partial cds" Jul. 25, 2016.
Cry1Aa2 GenBank Accession No. AAA22552 "insecticidal crystal protein, partial (plasmid) [Bacillus thuringiensis]" Dec. 3, 2020.
Cry1Aa20 GenBank Accession No. JF340156 "*Bacillus thuringiensis* strain SK-798 plasmid Cry toxin (cry) gene, complete cds" Jul. 25, 2016.
Cry1Aa21 GenBank Accession No. JN651496 "*Bacillus thuringiensis* strain LTS-209 Cry1Aa gene, partial cds" Feb. 5, 2015.
Cry1Aa22 GenBank Accession No. KC158223 "*Bacillus thuringiensis* strain Lip plasmid insecticidal crystal protein (cry1Aa) gene, complete cds" Jul. 26, 2016.
Cry1Aa3 GenBank Accession No. BAA00257 "unnamed protein product [Bacillus thuringiensis serovar aizawai]" Dec. 20, 2002.
Cry1Aa4 GenBank Accession No. CAA31886 "unnamed protein product [Bacillus thuringiensis]" Apr. 18, 2005.
Cry1Aa5 GenBank Accession No. BAA04468 "insecticidal crystal protein [Bacillus thuringiensis]" Jun. 15, 2010.
Cry1Aa6 GenBank Accession No. AAA86265 "CrylA(a), partial [Bacillus thuringiensis serovar kurstaki]" Jan. 30, 1996.
Cry1Aa7 GenBank Accession No. AAD46139 "insecticidal crystal protein [Bacillus thuringiensis]" Aug. 1, 1999.
Cry1Aa8 GenBank Accession No. 126149 "Sequence 9 from patent U.S. Pat. No. 5,556,784" Oct. 7, 1996.
Cry1Aa9 GenBank Accession No. BAA77213 "BtT84A1 crystal protein [Bacillus thuringiensis]" Mar. 14, 2003.
Cry1Ab10 GenBank Accession No. A29125 "parasporal crystal protein Bt2—*Bacillus thuringiensis* subsp. kurstaki (strain HD-1)" Dec. 1, 2000.
Cry1Ab12 GenBank Accession No. AAC64003 "crystal protein (plasmid) [Bacillus thuringiensis serovar kurstaki]" Jul. 25, 2016.
Cry1Ab13 GenBank Accession No. AAN76494 "insecticidal protein P [Bacillus thuringiensis]" Dec. 2, 2002.
Cry1Ab14 GenBank Accession No. AAG16877 "delta endotoxin [Bacillus thuringiensis]" Oct. 1, 2000.
Cry1Ab15 GenBank Accession No. AAO13302 "crystal endotoxin Cry1Ab [Bacillus thuringiensis]" Dec. 31, 2002.
Cry1Ab16 GenBank Accession No. AAK55546 "Cry1Ab16 [Bacillus thuringiensis]" Oct. 16, 2002.
Cry1Ab17 GenBank Accession No. AAT46415 "parasporal crystal protein [Bacillus thuringiensis]" Jun. 20, 2004.
Cry1Ab18 GenBank Accession No. AAQ88259 "cry1A toxin [Bacillus thuringiensis]" Aug. 19, 2005.
Cry1Ab19 GenBank Accession No. AAW31761 "Cry1Ab [Bacillus thuringiensis]" May 20, 2009.
Cry1Ab2 GenBank Accession No. AAA22613 "insecticidal endotoxin [Bacillus thuringiensis]" Apr. 26, 1993.
Cry1Ab20 GenBank Accession No. ABB72460 "insecticidal crystal protein Cry1Ab [Bacillus thuringiensis]" Dec. 1, 2008.
Cry1Ab21 GenBank Accession No. ABS18384 "delta-endotoxin Cry1Ab [Bacillus thuringiensis]" Feb. 19, 2008.
Cry1Ab22 GenBank Accession No. ABW87320 "endotoxin [Bacillus thuringiensis]" Nov. 6, 2007.
Cry1Ab23 GenBank Accession No. HQ439777 "*Bacillus thuringiensis* strain N32-2-2 Cry1A-like protein gene, partial cds" Jul. 25, 2016.
Cry1Ab24 GenBank Accession No. HQ439778 "*Bacillus thuringiensis* strain HD12 Cry1A-like protein gene, partial cds" Jul. 25, 2016.
Cry1Ab25 GenBank Accession No. HQ685122 "*Bacillus thuringiensis* strain LS-R-30 Cry1Ab gene, partial cds" Jul. 25, 2016.
Cry1Ab26 GenBank Accession No. HQ847729 "*Bacillus thuringiensis* serovar kurstaki strain Dor BT-1 delta-endotoxin Cry1Ab (cry1Ab) gene, complete cds" May 6, 2013.
Cry1Ab27 GenBank Accession No. JN135249 "*Bacillus thuringiensis* strain SSy125-c clone HA1 delta-endotoxin (cry1A) gene, partial cds" Sep. 15, 2012.

Cry1Ab28 GenBank Accession No. JN135250 "*Bacillus thuringiensis* strain SSy125-c clone HA2 delta-endotoxin-like (cry1A) gene, complete sequence" Sep. 15, 2012.
Cry1Ab29 GenBank Accession No. JN135251 "*Bacillus thuringiensis* strain SSy141-c clone HA6 delta-endotoxin (cry1A) gene, complete cds" Sep. 15, 2012.
Cry1Ab3 GenBank Accession No. AAA22561 "crystal protein precursor [Bacillus thuringiensis]" Apr. 26, 1993.
Cry1Ab30 GenBank Accession No. JN135252 "*Bacillus thuringiensis* strain SSy126-c clone HA7 delta-endotoxin (cry1A) gene, complete cds" Sep. 15, 2012.
Cry1Ab31 GenBank Accession No. JN135253 "*Bacillus thuringiensis* strain SSy126-c clone HA9 delta-endotoxin (cry1A) gene, complete cds" Sep. 15, 2012.
Cry1Ab32 GenBank Accession No. JN135254 "*Bacillus thuringiensis* strain SSy111-c clone HA11 delta-endotoxin (cry1A) gene, complete cds" Sep. 15, 2012.
Cry1Ab33 GenBank Accession No. AAS93798 "cry1A type crystal protein, partial [Bacillus thuringiensis serovar kenyae]" Jul. 26, 2016.
Cry1Ab34 GenBank Accession No. KC156668 "*Bacillus thuringiensis* strain ARP102 pesticidal protein gene, complete cds" Nov. 14, 2013.
Cry1Ab4 GenBank Accession No. BAA00071 "delta-endotoxin [*Bacillus thuringiensis* serovar kurstaki str. HD-1]" Sep. 29, 2007.
Cry1Ab5 GenBank Accession No. CAA28405 "unnamed protein product [Bacillus thuringiensis]" Apr. 18, 2005.
Cry1Ab6 GenBank Accession No. AAA22420 "5.3 class delta endotoxin [Bacillus thuringiensis]" Apr. 26, 1993.
Cry1Ab7 GenBank Accession No. CAA31620 "unnamed protein product [Bacillus thuringiensis]" Apr. 18, 2005.
Cry1Ab8 GenBank Accession No. AAA22551 "insecticidal protein [Bacillus thuringiensis]" Apr. 26, 1993.
Cry1Ab9 GenBank Accession No. CAA38701 "unnamed protein product [Bacillus thuringiensis]" Oct. 23, 2008.
Cry1Abl GenBank Accession No. AAA22330 "entomocidal protoxin [Bacillus thuringiensis]" Apr. 26, 1993.
Cry1Ab-like GenBank Accession No. AAK14336 "insecticidal crystal protein BTRX24 [Bacillus thuringiensis serovar kunthalaRX24]" Mar. 1, 2001.
Cry1Ab-like GenBank Accession No. AAK14337 "insecticidal crystal protein BTRX28 [Bacillus thuringiensis serovar kunthalaRX28]" Mar. 1, 2001.
Cry1Ab-like GenBank Accession No. AAK14338 "insecticidal crystal protein BTRX27 [Bacillus thuringiensis serovar kunthalaRX27]" Mar. 1, 2001.
Cry1Ab-like GenBank Accession No. ABG88858 "Cry1Ab-like BT toxin OL2, partial [Bacillus thuringiensis]" Jul. 14, 2016.
Cry1Ac1 GenBank Accession No. AAA22331 "crystal protein [Bacillus thuringiensis]" Apr. 26, 1993.
Cry1Ac12 GenBank Accession No. II2418 "Transporter, LysE family [Idiomarina loihiensis L2TR]" Jan. 31, 2014.
Cry1Ac13 GenBank Accession No. AAD38701 "insecticidal protein Cry1Ac, partial [Bacillus thuringiensis serovar kurstaki str. HD-1]" Jul. 26, 2016.
Cry1Ac14 GenBank Accession No. AAQ06607 "Cry1Ac [Bacillus thuringiensis]" Apr. 1, 2004.
Cry1Ac15 GenBank Accession No. AAN07788 "insecticidal crystal protein Cry1Ac [Bacillus thuringiensis]" Sep. 29, 2002.
Cry1Ac16 GenBank Accession No. AAU87037 "Cry1Ac (plasmid) [Bacillus thuringiensis]" Jul. 26, 2016.
Cry1Ac18 GenBank Accession No. AAY88347 "Cry [Bacillus thuringiensis]" Jun. 1, 2007.
Cry1Ac19 GenBank Accession No. ABD37053 "insecticidal crystal protein [Bacillus thuringiensis serovar kurstaki]" Feb. 20, 2006.
Cry1Ac2 GenBank Accession No. AAA22338 "delta-endotoxin [Bacillus thuringiensis]" Apr. 26, 1993.
Cry1Ac20 GenBank Accession No. ABB89046 "delta-endocytoxin [Bacillus thuringiensis]" May 1, 2006.
Cry1Ac21 GenBank Accession No. AAY66992 "Cry1Ac, partial [Bacillus thuringiensis]" May 16, 2007.
Cry1Ac22 GenBank Accession No. ABZ01836 "Cry1Ac22 [Bacillus thuringiensis serovar kurstaki]" Dec. 1, 2008.

(56)  References Cited

OTHER PUBLICATIONS

Cry1Ac23 GenBank Accession No. CAQ30431 "pesticidal crystal protein cry1Ac, partial (plasmid) [Bacillus thuringiensis serovar kurstaki]" Jul. 26, 2016.

Cry1Ac24 GenBank Accession No. ABL01535 "crystal protein [Bacillus thuringiensis]" Dec. 6, 2006.

Cry1Ac25 GenBank Accession No. FJ513324 "*Bacillus thuringiensis* strain Tm37-6 pesticidal crystal protein (cry1Ac) gene, partial cds" Jul. 24, 2016.

Cry1Ac26 GenBank Accession No. FJ617446 "*Bacillus thuringiensis* strain Tm41-4 Cry1Ac-like protein (cry1Ac) gene, partial cds" Jul. 24, 2016.

Cry1Ac27 GenBank Accession No. FJ617447 "*Bacillus thuringiensis* strain Tm44-1B Cry1Ac-like protein (cry1Ac) gene, partial cds" Jul. 24, 2016.

Cry1Ac28 GenBank Accession No. ACM90319 "Cry1Ac [Bacillus thuringiensis]" Feb. 17, 2009.

Cry1Ac29 GenBank Accession No. DQ438941 "*Bacillus thuringiensis* strain Inta TA24-6 insecticidal crystal protein (Cry1Ac) gene, partial cds" Apr. 1, 2006.

Cry1Ac3 GenBank Accession No. CAA38098 "unnamed protein product, partial [Bacillus thuringiensis]" Jul. 26, 2016.

Cry1Ac30 GenBank Accession No. GQ227507 "*Bacillus thuringiensis* strain S1478-1 toxin crystal protein gene, complete cds" Oct. 15, 2010.

Cry1Ac31 GenBank Accession No. GU446674 "*Bacillus thuringiensis* strain S3299-1 Cry1Ac gene, complete cds" Feb. 1, 2011.

Cry1Ac32 GenBank Accession No. HM061081 "*Bacillus thuringiensis* strain ZQ-89 insecticidal crystal protein Cry1Ac gene, complete cds" Jun. 1, 2010.

Cry1Ac33 GenBank Accession No. GQ866913 "*Bacillus thuringiensis* strain SK-711 plasmid crystal protein (cry1) gene, partial cds" Jul. 25, 2016.

Cry1Ac34 GenBank Accession No. HQ230364 "Synthetic construct clone EC-783 cry1Ac protein (cry1Ac) gene, cry1Ac18 allele, complete cds" Dec. 18, 2010.

Cry1Ac35 GenBank Accession No. JF340157 "*Bacillus thuringiensis* strain SK-784 plasmid Cry toxin (cry) gene, complete cds" Jul. 25, 2016.

Cry1Ac36 GenBank Accession No. JN387137 "Bacillus thuringiensis isolate SK-958 truncated crystal protein PT-958 gene, complete cds" Dec. 1, 2012.

Cry1Ac37 GenBank Accession No. JQ317685 "*Bacillus thuringiensis* strain SK-793 plasmid truncated crystal protein gene, complete cds" Jul. 25, 2016.

Cry1Ac4 GenBank Accession No. AAA73077 "insecticidal delta endotoxin [Bacillus thuringiensis serovar kurstaki]" Apr. 26, 1993.

Cry1Ac5 GenBank Accession No. AAA22339 "crylA(c)3 [Bacillus thuringiensis serovar kurstaki]" Apr. 26, 1993.

Cry1Ac6 GenBank Accession No. AAA86266 "CrylA(c), partial [Bacillus thuringiensis serovar kurstaki]" Jan. 30, 1996.

Cry1Ac7 GenBank Accession No. AAB46989 "insecticidal delta-endotoxin CrylA(c) [Bacillus thuringiensis serovar kurstaki]" Feb. 11, 1997.

Cry1Ac8 GenBank Accession No. AAC44841 "crystal protein [Bacillus thuringiensis serovar kurstaki]" Feb. 18, 1997.

Cry1Ac9 GenBank Accession No. AAB49768 "Cry1Ac delta-endotoxin [Bacillus thuringiensis]" Mar. 17, 1997.

Cry1Ad2 GenBank Accession No. CAA01880 "PS81RR1 endotoxin, partial [Bacillus thuringiensis]" Sep. 25, 1995.

Cry1Ah2 GenBank Accession No. ABB76664 "Cry1A-type pesticidal crystal protein, partial [Bacillus thuringiensis serovar alesti]" Jul. 26, 2016.

Cry1Ah3 GenBank Accession No. HQ439779 *Bacillus thuringiensis* strain S6 Cry1A-like protein gene, partial cds. Jul. 25, 2016.

Cry1Ai2 GenBank Accession No. HQ439780 "*Bacillus thuringiensis* strain SC6H8 Cry1A-like protein gene, partial cds" Jul. 25, 2016.

Cry1A-like GenBank Accession No. AAK14339 "insecticidal crystal protein BTRX3 [Bacillus thuringiensis serovar kunthalanags3]" Mar. 1, 2001.

Cry1Ba2 GenBank Accession No. CAA65003 "cry1Ba2 [Bacillus thuringiensis serovar entomocidus]" Apr. 18, 2005.

Cry1Ba3 GenBank Accession No. AAK63251 "Cry1Ba [Bacillus thuringiensis]" Sep. 30, 2003.

Cry1Ba4 GenBank Accession No. AAK51084 "delta-endotoxin Cry1 Ba2 [Bacillus thuringiensis serovar entomocidus]" Nov. 2, 2006.

Cry1Ba5 GenBank Accession No. AB020894 "Oryza sativa Indica Group RNA for retroposon p-SINE1-RC207" Dec. 20, 2010.

Cry1Ba6 GenBank Accession No. ABL60921 "Cry1B (plasmid) [Bacillus thuringiensis]" Jul. 14, 2016.

Cry1Ba7 GenBank Accession No. HQ439781 "*Bacillus thuringiensis* strain N17-37 Cry1B-like protein gene, partial cds" Jul. 25, 2016.

Cry1Bal GenBank Accession No. CAA29898 "unnamed protein product [Bacillus thuringiensis]" Apr. 18, 2005.

Cry1Bb2 GenBank Accession No. HQ439782 "*Bacillus thuringiensis* strain WBT-2 Cry1B-like protein gene, partial cds" Jul. 25, 2016.

Cry1Bcl GenBank Accession No. CAA86568 "delta-endotoxin [Bacillus thuringiensis serovar morrisoni]" Apr. 18, 2005.

Cry1Bd2 GenBank Accession No. AAM93496 "CrylBII [Bacillus thuringiensis]" Aug. 13, 2002.

Cry1Bdl GenBank Accession No. AAD10292 "insecticidal crystal protein CryE1 [Bacillus thuringiensis serovar wuhanensis]" Jan. 29, 1999.

Cry1Be2 GenBank Accession No. AAQ52387 "Sequence 63 from patent U.S. Pat. No. 6,593,293" Aug. 17, 2003.

Cry1Be3 GenBank Accession No. ACV96720 "Cry1Be2 [Bacillus thuringiensis]" Aug. 10, 2010.

Cry1Be4 GenBank Accession No. HM070026 "*Bacillus thuringiensis* strain SC6H8 Cry1Be-like protein gene, partial cds" Jul. 25, 2016.

Cry1Bf2 GenBank Accession No. AAQ52380 "Sequence 38 from patent U.S. Pat. No. 6,593,293" Aug. 17, 2003.

Cry1Bgl GenBank Accession No. AAO39720 "insecticidal crystal protein [Bacillus thuringiensis]", Dec. 1, 2005.

Cry1Bhl GenBank Accession No. HQ589331 "*Bacillus thuringiensis* strain PS46L insecticidal crystal protein DIG-3 gene, complete cds" Dec. 20, 2010.

Cry1Bil GenBank Accession No. KC156700 "*Bacillus thuringiensis* strain ARP260 pesticidal protein gene, complete cds" Nov. 14, 2013.

Cry1Ca11GenBank Accession No. AAX53094 "insecticidal crystal protein Cry1C [Bacillus thuringiensis]" Mar. 28, 2005.

Cry1Ca12 GenBank Accession No. HM070027 "*Bacillus thuringiensis* strain mo3-E7 Cry1Ca-like protein gene, partial cds" Jul. 25, 2016.

Cry1Ca13 GenBank Accession No. HQ412621 *Bacillus thuringiensis* strain LB-R-78 Cry1C-like protein gene, partial cds Nov. 30, 2012.

Cry1Ca14 GenBank Accession No. JN651493 "*Bacillus thuringiensis* strain LTS-38 Cry1Ca gene, partial cds" Feb. 5, 2015.

Cry1Ca2 GenBank Accession No. CAA31951 "unnamed protein product, partial [Bacillus thuringiensis]" Jul. 26, 2016.

Cry1Ca3 GenBank Accession No. AAA22343 crylC(b) [Bacillus thuringiensis serovar aizawai] Apr. 26, 1993.

Cry1Ca4 GenBank Accession No. CAA01886 "bt15 [Bacillus thuringiensis serovar entomocidus]" Sep. 25, 1995.

Cry1Ca5 GenBank Accession No. CAA65457 "delta-endotoxin, partial [Bacillus thuringiensis serovar aizawai]" Jul. 14, 2016.

Cry1Ca6 [1] GenBank Accession No. AAF37224 "toxin Cry1Ca6 [Bacillus thuringiensis]" Mar. 2, 2000.

Cry1Ca7 GenBank Accession No. AAG50438 "Cry1Ca (plasmid) [Bacillus thuringiensis]" Jul. 26, 2016.

Cry1Ca8 GenBank Accession No. AAM00264 "insecticidal protein Cry1Ca [Bacillus thuringiensis]" Apr. 2, 2002.

Cry1Ca9 GenBank Accession No. AAL79362 "delta-endotoxin [Bacillus thuringiensis]" Jun. 22, 2007.

Cry1Cal GenBank Accession No. CAA30396 "unnamed protein product [Bacillus thuringiensis]" Apr. 18, 2005.

Cry1Cb2 GenBank Accession No. AAG35409 "insecticidal crystal protein Cry1Cb (plasmid) [Bacillus thuringiensis]" Jul. 26, 2016.

Cry1Cb3 GenBank Accession No. ACD50894 "Cry1C [Bacillus thuringiensis]" May 20, 2008.

Cry1Cb-like GenBank Accession No. AAX63901 "crystal endotoxin, partial [Bacillus thuringiensis]" Jul. 26, 2016.

(56)        References Cited

OTHER PUBLICATIONS

Cry1Da2 GenBank Accession No. I76415 "Sequence 3 from patent U.S. Pat. No. 5,691,308" Apr. 3, 1998.
Cry1Da3 GenBank Accession No. HQ439784 "*Bacillus thuringiensis* strain HD12 Cry1D-like protein gene, partial cds" Jul. 25, 2016.
Cry1Dal GenBank Accession No. CAA38099 "unnamed protein product [Bacillus thuringiensis]" Oct. 23, 2008.
Cry1Ea2 GenBank Accession No. CAA39609 "crystal protein [Bacillus thuringiensis]" Apr. 18, 2005.
Cry1Ea3 GenBank Accession No. AAA22345 "crylE(a) [Bacillus thuringiensis serovar kenyae]" Apr. 26, 1993.
Cry1Ea4 GenBank Accession No. AAD04732 "Cry1Ea4 [Bacillus thuringiensis]" Jan. 14, 1999.
Cry1Ea5 GenBank Accession No. A15535 "bt18 gene" Feb. 18, 1994.
Cry1Ea6 GenBank Accession No. AAL50330 "Cry032 [Bacillus thuringiensis]" Dec. 27, 2001.
Cry1Ea7 GenBank Accession No. AAW72936 "insecticidal delta endotoxin CrylEa [Bacillus thuringiensis]" Mar. 25, 2005.
Cry1Ea8 GenBank Accession No. ABX11258 "Cry1Ea [Bacillus thuringiensis]" Nov. 19, 2007.
Cry1Ea9 GenBank Accession No. HQ439785 "*Bacillus thuringiensis* strain S6 Cry1E-like protein gene, partial cds" Jul. 25, 2016.
Cry1Eal GenBank Accession No. CAA37933 "crystal protein [Bacillus thuringiensis]" Apr. 18, 2005.
Cry1Ebl GenBank Accession No. AAA22346 "crylE(b) [Bacillus thuringiensis serovar aizawai]" Apr. 26, 1993.
Cry1Fa2 GenBank Accession No. AAA22347 "crylF [Bacillus thuringiensis serovar aizawai]" Apr. 26, 1993.
Cry1Fa3 GenBank Accession No. HM070028 "*Bacillus thuringiensis* strain mo3-D8 Cry1Fa-like protein gene, partial cds" Jul. 25, 2016.
Cry1Fa4 GenBank Accession No. HM439638 "*Bacillus thuringiensis* strain mo3-D10 Cry1F-like protein gene, partial cds" Jul. 25, 2016.
Cry1Fal GenBank Accession No. AAA22348 "insecticidal crystal protein [Bacillus thuringiensis serovar aizawai]" Apr. 26, 1993.
Cry1Fb2 GenBank Accession No. BAA25298 "CrylNA67-1 [Bacillus thuringiensis serovar morrisoni]" Feb. 5, 1999.
Cry1Fb3 GenBank Accession No. AAF21767 "crystal protein Cry1Fb [Bacillus thuringiensis serovar morrisoni]" Jan. 1, 2000.
Cry1Fb4 GenBank Accession No. AAC10641 "Sequence 4 from patent U.S. Pat. No. 5,686,069" Apr. 3, 1998.
Cry1Fb5 GenBank Accession No. AAO13295 "crystal delta-endotoxin [Bacillus thuringiensis]" Dec. 31, 2002.
Cry1Fb6 GenBank Accession No. ACD50892 "Cry1F [Bacillus thuringiensis]" May 20, 2008.
Cry1Fb7 GenBank Accession No. ACD50893 "Cry1F [Bacillus thuringiensis]" May 20, 2008.
Cry1Ga2 GenBank Accession No. CAA70506 "delta-endotoxin [Bacillus thuringiensis serovar wuhanensis]" Apr. 2, 1997.
Cry1Gb2 GenBank Accession No. AAO13756 "delta-endotoxin Cry1 [Bacillus thuringiensis]" Sep. 30, 2003.
Cry1Hb2 GenBank Accession No. HQ439786 "*Bacillus thuringiensis* strain WBT-2 Cry1H-like protein gene, partial cds" Jul. 25, 2016.
Cry1Ia10 GenBank Accession No. AAP86782 "Cry1I [Bacillus thuringiensis]" Sep. 25, 2003.
Cry1Ia12 GenBank Accession No. AAV53390 "delta endotoxin [Bacillus thuringiensis]" Nov. 30, 2007.
Cry1Ia13 GenBank Accession No. ABF83202 "Cry1Ia [Bacillus thuringiensis]" Apr. 11, 2008.
Cry1Ia14 GenBank Accession No. ACG63871 "Cry1Ia [Bacillus thuringiensis]" Aug. 17, 2008.
Cry1Ia15 GenBank Accession No. FJ617445 "*Bacillus thuringiensis* strain E-1B Cry1Ia-like protein (cry1Ia) gene, complete cds" Jun. 1, 2011.
Cry1Ia16 GenBank Accession No. FJ617448 "*Bacillus thuringiensis* strain E-1A Cry1Ia-like protein (cry1Ia) gene, complete cds" Jun. 1, 2011.
Cry1Ia2 GenBank Accession No. AAA22354 "insecticidal protein [Bacillus thuringiensis serovar kurstaki]" Jul. 27, 1993.

Cry1Ia20 GenBank Accession No. JQ228426 "*Bacillus thuringiensis* strain wu1E-3 Cry1Ia (cry1Ia) gene, complete cds" Nov. 30, 2015.
Cry1Ia21 GenBank Accession No. JQ228424 "*Bacillus thuringiensis* strain wu1E-4 Cry1Ia (cry1Ia) gene, partial cds" Nov. 30, 2015.
Cry1Ia22 GenBank Accession No. JQ228427 "*Bacillus thuringiensis* strain wu2B-6 Cry1Ia (cry1Ia) gene, complete cds" Nov. 30, 2015.
Cry1Ia23 GenBank Accession No. JQ228428 "*Bacillus thuringiensis* strain wu2G-11 Cry1Ia (cry1Ia) gene, complete cds" Nov. 30, 2015.
Cry1Ia24 GenBank Accession No. JQ228429 "*Bacillus thuringiensis* strain wu2G-12 Cry1Ia (cry1Ia) gene, complete cds" Nov. 30, 2015.
Cry1Ia25 GenBank Accession No. JQ228430 "*Bacillus thuringiensis* strain you1D-9 Cry1Ia (cry1Ia) gene, complete cds" Nov. 30, 2015.
Cry1Ia26 GenBank Accession No. JQ228431 "*Bacillus thuringiensis* strain you2D-3 Cry1Ia (cry1Ia) gene, complete cds" Nov. 30, 2015.
Cry1Ia27 GenBank Accession No. JQ228432 "*Bacillus thuringiensis* strain you2E-3 Cry1Ia (cry1Ia) gene, complete cds" Nov. 30, 2015.
Cry1Ia28 GenBank Accession No. JQ228433 "*Bacillus thuringiensis* strain you2F-3 Cry1Ia (cry1Ia) gene, complete cds" Nov. 30, 2015.
Cry1Ia29 GenBank Accession No. JQ228434 "*Bacillus thuringiensis* strain wu1H-3 Cry1Ia (cry1Ia) gene, complete cds" Nov. 30, 2015.
Cry1Ia3 GenBank Accession No. AAC36999 "insecticidal protein [Bacillus thuringiensis serovar kurstaki]" Jul. 31, 1995.
Cry1Ia30 GenBank Accession No. JQ317686 "*Bacillus thuringiensis* strain BGSC 4J4 plasmid crystal protein (cry1I) gene, complete cds" Jul. 25, 2016.
Cry1Ia31 GenBank Accession No. JX944038 "*Bacillus thuringiensis* strain SC-7 Cry1Ia (cry1Ia) gene, complete cds" Oct. 17, 2012.
Cry1Ia32 GenBank Accession No. JX944039 "*Bacillus thuringiensis* strain SC-13 Cry1Ia (cry1Ia) gene, partial cds" Oct. 17, 2012.
Cry1Ia33 GenBank Accession No. JX944040 "*Bacillus thuringiensis* strain SC-51 Cry1Ia (cry1Ia) gene, complete cds" Oct. 17, 2012.
Cry1Ia4 GenBank Accession No. AAB00958 "CGCryV [Bacillus thuringiensis]" May 28, 1996.
Cry1Ia6 GenBank Accession No. AAC26910 "insecticidal protein (plasmid) [Bacillus thuringiensis serovar kurstaki]" Jul. 25, 2016.
Cry1Ia7 GenBank Accession No. AAM73516 "Cry [Bacillus thuringiensis]" Jul. 5, 2006.
Cry1Ia8 GenBank Accession No. AAK66742 "Cry1Ia [Bacillus thuringiensis]" Oct. 1, 2003.
Cry1Ia9 GenBank Accession No. AAQ08616 "Cry1Ia, partial [Bacillus thuringiensis]" Jul. 25, 2016.
Cry1Ib10 GenBank Accession No. JN675716 "*Bacillus thuringiensis* strain BT HMM Cry1I crystal toxin protein (cry1I) gene, complete cds" Oct. 2, 2011.
Cry1Ib2 GenBank Accession No. ABW88019 "Cry1Ib-type protein [Bacillus thuringiensis]" Nov. 7, 2007.
Cry1Ib3 GenBank Accession No. ACD75515 "Cry1Ib-type protein [Bacillus thuringiensis]" May 28, 2008.
Cry1Ib4 GenBank Accession No. HM051227 "Bacillus thuringiensis delta endotoxin gene, complete cds" Jan. 1, 2011.
Cry1Ib6 GenBank Accession No. ADK38579 "insecticidal crystal protein Cry1Ib [Bacillus thuringiensis]" Jul. 24, 2010.
Cry1Ib7 GenBank Accession No. JN571740 "Bacillus thuringiensis strain SK-935 plasmid Cry1I-like protein gene, partial cds" Jul. 25, 2016.
Cry1Ib8 GenBank Accession No. JN675714 "*Bacillus thuringiensis* strain BT HMM-AND7B Cry1I crystal toxin protein (cry1I) gene, complete cds" Oct. 2, 2011.
Cry1Ib9 GenBank Accession No. JN675715 "*Bacillus thuringiensis* strain BT HMM-BRT2A Cry1I crystal toxin protein (cry1I) gene, complete cds" Oct. 2, 2011.
Cry1Ic2 GenBank Accession No. AAE71691 "Sequence 2 from patent U.S. Pat. No. 6,232,439" Aug. 8, 2001.
Cry1Id2 GenBank Accession No. JQ228422 "*Bacillus thuringiensis* strain HD12 Cry1Id (cry1Id) gene, complete cds" Nov. 30, 2015.
Cry1Ie2 GenBank Accession No. HM439636 "*Bacillus thuringiensis* strain T03B001 Cry1I-like protein gene, partial cds" May 6, 2015.
Cry1Ie3 GenBank Accession No. KC156647 "*Bacillus thuringiensis* strain ARP058 pesticidal protein gene, complete cds" Nov. 14, 2013.
Cry1Ie4 GenBank Accession No. KC156681 "*Bacillus thuringiensis* strain ARP131 pesticidal protein gene, complete cds" Nov. 14, 2013.

(56)     References Cited

OTHER PUBLICATIONS

Cry1Ja2 GenBank Accession No. HM070030 "*Bacillus thuringiensis* strain WBT-2 Cry1Ja-like protein gene, partial cds" Jul. 25, 2016.
Cry1Ja3 GenBank Accession No. JQ228425 "*Bacillus thuringiensis* strain FH21 Cry1Ja (cry1Ja) gene, partial cds" Nov. 30, 2015.
Cry1Jc2 GenBank Accession No. AAQ52372 "Sequence 22 from patent U.S. Pat. No. 6,593,293" Aug. 17, 2003.
Cry1Ka2 GenBank Accession No. HQ439783 "*Bacillus thuringiensis* strain WBT-2 Cry1K-like protein gene, partial cds" Jul. 25, 2016.
Cry1La2 GenBank Accession No. HM070031 "*Bacillus thuringiensis* strain SC6H8 Cry1La-like protein gene, partial cds" Jul. 25, 2016.
Cry1Ma2 GenBank Accession No. KC156659 "*Bacillus thuringiensis* strain ARP080 pesticidal protein gene, complete cds" Nov. 14, 2013.
Cry20Aal GenBank Accession No. AAB93476 "mosquitocidal toxin [Bacillus thuringiensis]" Dec. 29, 1997.
Cry20Ba2 GenBank Accession No. KC156694 "*Bacillus thuringiensis* strain ARP192 pesticidal protein gene, complete cds" Nov. 14, 2013.
Cry20Bal GenBank Accession No. ACS93601 "Cry20-like delta endotoxin (plasmid) [Bacillus thuringiensis]" Jul. 24, 2016.
Cry20-like GenBank Accession No. GQ144333 "*Bacillus thuringiensis* strain Y-5 insecticidal crystal protein (cry20) pseudogene, complete sequence" Jun. 17, 2009.
Cry21Aa2 GenBank Accession No. I66477 "Sequence 8 from U.S. Pat. No. 5,670,365" Dec. 28, 1997.
Cry21Aal GenBank Accession No. I32932 "Sequence 5 from U.S. Pat. No. 5,589,382" Feb. 6, 1997.
Cry21 Bal GenBank Accession No. BAC06484 "Cry21Ba1 [Bacillus thuringiensis serovar roskildiensis]" Jan. 25, 2005.
Cry21Ca2 GenBank Accession No. KC156687 "*Bacillus thuringiensis* strain ARP258 pesticidal protein gene, complete cds" Nov. 14, 2013.
Cry21Cal GenBank Accession No. JF521577 "*Bacillus thuringiensis* strain Sbt072 Cry21Ba1-like protein gene, complete cds" Feb. 21, 2013.
Cry21Dal GenBank Accession No. JF521578 "*Bacillus thuringiensis* strain Sbt072 Cry21 Ba2-like protein gene, complete cds" Feb. 21, 2013.
Cry22Aa2 GenBank Accession No. CAD43579 "unnamed protein product [Bacillus thuringiensis]" Aug. 9, 2002.
Cry22Aa3 GenBank Accession No. ACD93211 "delta-endotoxin [Bacillus thuringiensis]" Jun. 9, 2008.
Cry22Aal GenBank Accession No. I34547 "Sequence 50 from U.S. Pat. No. 5,596,071" Feb. 6, 1997.
Cry22Ab2 GenBank Accession No. CAD43577 "unnamed protein product, partial [Bacillus thuringiensis]" Aug. 9, 2002.
Cry22Abl GenBank Accession No. AAK50456 "insecticidal crystal protein CryET70 [Bacillus thuringiensis]" Jun. 15, 2001.
Cry22Bal GenBank Accession No. CAD43578 "unnamed protein product [Bacillus thuringiensis]" Aug. 9, 2002.
Cry22Bbl GenBank Accession No. KC156672 "*Bacillus thuringiensis* strain ARP148 pesticidal protein gene, complete cds" Nov. 14, 2013.
Cry23Aal GenBank Accession No. AAF76375 "crystal protein [Bacillus thuringiensis]" Jun. 16, 2000.
Cry24Aal GenBank Accession No. AAC61891 "insecticidal protein Jeg72, partial [Bacillus thuringiensis serovar jegathesan]" Sep. 30, 1998.
Cry24Bal GenBank Accession No. BAD32657 "delta-endotoxin [Bacillus thuringiensis]" Aug. 17, 2005.
Cry24Cal GenBank Accession No. CAJ43600 "pesticidal crystal protein cry24-like [Bacillus thuringiensis]" Mar. 27, 2007.
Cry25Aal GenBank Accession No. AAC61892 "insecticidal protein Jeg74 [Bacillus thuringiensis serovar jegathesan]" Sep. 30, 1998.
Cry26Aal GenBank Accession No. AAD25075 "Cry26Aa1 protein [Bacillus thuringiensis serovar finitimus]" Jan. 14, 2000.
Cry27Aal GenBank Accession No. BAA82796 "94kDa mosquitocidal toxin [Bacillus thuringiensis serovar higo]" Jul. 1, 2009.

Cry28Aa2 GenBank Accession No. AAG00235 "parasporal inclusion protein Cry [Bacillus thuringiensis serovar finitimus]" Aug. 16, 2000.
Cry28Aal GenBank Accession No. AAD24189 "Cry28Aa1 delta-endotoxin [Bacillus thuringiensis serovar finitimus]" Jan. 14, 2000.
Cry29Aal GenBank Accession No. CAC80985 "Cry29Aa protein [Bacillus thuringiensis serovar medellin]" Jan. 13, 2006.
Cry2Aa12 GenBank Accession No. AB183671 "*Scrippsiella* sp. MBIC11143 gene for 18S rRNA, partial sequence, strain: MBIC11143" Jul. 22, 2004.
Cry2Aa13 GenBank Accession No. ABL01536 "crystal protein [Bacillus thuringiensis]" Dec. 6, 2006.
Cry2Aa14 GenBank Accession No. ACF04939 "Cry2Aa [Bacillus thuringiensis serovar kenyae]" Jul. 23, 2009.
Cry2Aa15 GenBank Accession No. JN426947 "*Bacillus thuringiensis* strain SSy77 clone HA22 delta-endotoxin (cry2A) gene, complete cds" Sep. 15, 2012.
Cry2Aa2 GenBank Accession No. AAA83516 "insecticidal crystal protein [Bacillus thuringiensis serovar kurstaki]" Dec. 15, 1995.
Cry2Aa3 GenBank Accession No. D86064 "rho operon leader peptide [imported]—*Escherichia coli* (strain O157:H7, substrain EDL933" May 17, 2002.
Cry2Aa4 GenBank Accession No. AAC04867 "insecticidal crystal protein [Bacillus thuringiensis]" Mar. 24, 2010.
Cry2Aa5 GenBank Accession No. CAA10671 "Cry2Aa protein [Bacillus thuringiensis]" Apr. 15, 2005.
Cry2Aa6 GenBank Accession No. CAA10672 "Cry2Aa protein [Bacillus thuringiensis]" Apr. 15, 2005.
Cry2Aa7 GenBank Accession No. CAA10670 "Cry2A protein, partial [Bacillus thuringiensis]" Jul. 26, 2016.
Cry2Aa8 GenBank Accession No. AAO13734 "insecticidal crystal protein Cry2Aa [Bacillus thuringiensis]" Jan. 1, 2003.
Cry2Aa9 GenBank Accession No. AAO13750 "Cry2Aa [Bacillus thuringiensis]" Sep. 30, 2003.
Cry2Aal 1 GenBank Accession No. AAQ52384 "Sequence 46 from U.S. Pat. No. 6,593,293" Aug. 17, 2003.
Cry2Aal GenBank Accession No. AAA22335 "P2 crystal protein [Bacillus thuringiensis]" Apr. 26, 1993.
Cry2Aal O GenBank Accession No. AAQ04263 "Cry2Aa [Bacillus thuringiensis]" Nov. 1, 2004.
Cry2Ab10 GenBank Accession No. EF157306 "*Bacillus thuringiensis* strain lyD cry2A-type insecticidal crystal protein gene, complete cds" Jan. 3, 2007.
Cry2Ab12 GenBank Accession No. ABM21764 "cry2A-type insecticidal crystal protein [Bacillus thuringiensis]" Jan. 3, 2007.
Cry2Ab13 GenBank Accession No. ACG76120 "pesticidal crystal protein [Bacillus thuringiensis]" Aug. 20, 2008.
Cry2Ab14 GenBank Accession No. ACG76121 "pesticidal crystal protein [Bacillus thuringiensis]" Aug. 20, 2008.
Cry2Ab15 GenBank Accession No. HM037126 "*Bacillus thuringiensis* strain YY1 insecticidal crystal protein gene, complete cds" Mar. 1, 2011.
Cry2Ab16 GenBank Accession No. GQ866914 "*Bacillus thuringiensis* strain SK-793 plasmid crystal protein (cry2A) gene, complete cds" Jul. 25, 2016.
Cry2Ab18 GenBank Accession No. JN135255 "*Bacillus thuringiensis* strain SSy125-c clone HA13 delta-endotoxin (cry2A) gene, complete cds" Sep. 15, 2012.
Cry2Ab19 GenBank Accession No. JN135256 "*Bacillus thuringiensis* strain SSy60-b clone HA14 delta-endotoxin (cry2A) gene, complete cds" Sep. 15, 2012.
Cry2Ab2 GenBank Accession No. CAA39075 "crystal protein CryllB [Bacillus thuringiensis serovar kurstaki]" Apr. 18, 2005.
Cry2Ab20 GenBank Accession No. JN135257 "*Bacillus thuringiensis* strain SSy60-b clone HA16 delta-endotoxin (cry2A) gene, complete cds" Sep. 15, 2012.
Cry2Ab21 GenBank Accession No. JN135258 "*Bacillus thuringiensis* strain SSy141-c clone HA17 delta-endotoxin (cry2A) gene, complete cds" Sep. 15, 2012.
Cry2Ab22 GenBank Accession No. JN135259 "*Bacillus thuringiensis* strain SSy126-c clone HA18 delta-endotoxin (cry2A) gene, complete cds" Sep. 15, 2012.

(56) References Cited

OTHER PUBLICATIONS

Cry2Ab23 GenBank Accession No. JN135260 "*Bacillus thuringiensis* strain SSy126-c clone HA19 delta-endotoxin (cry2A) gene, partial cds" Sep. 15, 2012.

Cry2Ab24 GenBank Accession No. JN135261 "*Bacillus thuringiensis* strain SSy111-c clone HA20 delta-endotoxin (cry2A) gene, complete cds" Sep. 15, 2012.

Cry2Ab25 GenBank Accession No. JN415485 "*Bacillus thuringiensis* serovar kurstaki strain MnD insecticidal crystal protein (cry2Ab) gene, complete cds" Apr. 17, 2013.

Cry2Ab26 GenBank Accession No. JN426946 "*Bacillus thuringiensis* strain SSy77 clone HA21 delta-endotoxin (cry2A) gene, complete cds" Sep. 15, 2012.

Cry2Ab27 GenBank Accession No. JN415764 "*Bacillus thuringiensis* strain SP41 Cry2Ab protein (cry2Ab) gene, complete cds" Aug. 28, 2011.

Cry2Ab28 GenBank Accession No. JN651494 "*Bacillus thuringiensis* strain LTS-7 Cry2Aab gene, complete cds" Feb. 5, 2015.

Cry2Ab3 GenBank Accession No. AAG36762 "Cry2Ab [Bacillus thuringiensis]" Dec. 2, 2000.

Cry2Ab4 GenBank Accession No. AAO13296 "crystal delta-endotoxin [Bacillus thuringiensis]" Dec. 31, 2002.

Cry2Ab5 GenBank Accession No. AAQ04609 "Cry2Ab [Bacillus thuringiensis]" Nov. 1, 2004.

Cry2Ab6 GenBank Accession No. AAP59457 "crystal delta-endotoxin Cry2ab-HB [Bacillus thuringiensis]" Jun. 17, 2003.

Cry2Ab7 GenBank Accession No. AAZ66347 "delta endotoxin [Bacillus thuringiensis]" Aug. 1, 2007.

Cry2Ab8 GenBank Accession No. ABC95996 "Cry2Ab [Bacillus thuringiensis]" Feb. 8, 2006.

Cry2Ab9 GenBank Accession No. ABC74968 "crystal delta-endotoxin cry2Ab [Bacillus thuringiensis]" Feb. 1, 2007.

Cry2Abl7 GenBank Accession No. HQ439789 "*Bacillus thuringiensis* strain PS9-C12 Cry2A-like protein gene, partial cds" Jul. 25, 2016.

Cry2Abl GenBank Accession No. AAA22342 "crystal protein B2 [Bacillus thuringiensis]" Apr. 26, 1993.

Cry2Abl1 GenBank Accession No. CAM84575 "cry2Abl1 delta endotoxin [Bacillus thuringiensis]" Jan. 10, 2009.

Cry2Ac10 GenBank Accession No. ABN15104 "insecticidal crystal protein [Bacillus thuringiensis]" Feb. 12, 2007.

Cry2Ac12 GenBank Accession No. CAM83896 "Cry2Ac12 protein [Bacillus thuringiensis]" Jan. 10, 2009.

Cry2Ac2 GenBank Accession No. AAG35410 "insecticidal crystal protein Cry2Ac [Bacillus thuringiensis]" Jan. 3, 2006.

Cry2Ac3 GenBank Accession No. AAQ52385 "Sequence 48 from U.S. Pat. No. 6,593,293" Aug. 17, 2003.

Cry2Ac4 GenBank Accession No. ABC95997 "Cry2Ac [Bacillus thuringiensis]" Feb. 8, 2006.

Cry2Ac5 GenBank Accession No. ABC74969 "crystal delta-endotoxin cry2Ac [Bacillus thuringiensis]" Mar. 12, 2007.

Cry2Ac6 GenBank Accession No. ABC74793 "insecticidal crystal protein Cry2Ac [Bacillus thuringiensis serovar wuhanensis]" Jan. 29, 2006.

Cry2Ac7 GenBank Accession No. CAL18690 "cry2Ac7 protein [Bacillus thuringiensis]" Dec. 17, 2008.

Cry2Ac8 GenBank Accession No. CAM09325 "insecticidal crystal protein Cry2Ac8 [Bacillus thuringiensis]" Jan. 10, 2009.

Cry2Ac9 GenBank Accession No. CAM09326 "insecticidal crystal protein Cry2Ac9 [Bacillus thuringiensis]" Jan. 10, 2009.

Cry2Acl GenBank Accession No. CAA40536 "CryllC delta-endotoxin [Bacillus thuringiensis]" Apr. 18, 2005.

Cry2Acl1 GenBank Accession No. CAM83895 "Cry2Ac11 protein [Bacillus thuringiensis]" Jan. 10, 2009.

Cry2Ad2 GenBank Accession No. ABC86927 "crystal protein Cry2Ad [Bacillus thuringiensis]" Feb. 4, 2006.

Cry2Ad3 GenBank Accession No. CAK29504 "crystal protein [Bacillus thuringiensis]" Jan. 10, 2009.

Cry2Ad4 GenBank Accession No. CAM32331 "crystal protein cry2Ad4 [Bacillus thuringiensis]" Jan. 10, 2009.

Cry2Ad5 GenBank Accession No. CAO78739 "insecticidal crystal protein [Bacillus thuringiensis]" Dec. 14, 2008.

Cry2Adl GenBank Accession No. AAF09583 "crystal protein [Bacillus thuringiensis]" Nov. 22, 1999.

Cry2Ael GenBank Accession No. AAQ52362 "Sequence 2 from U.S. Pat. No. 6,593,293" Aug. 17, 2003.

Cry2Af2 GenBank Accession No. GQ866915 "*Bacillus thuringiensis* strain SK-758 plasmid crystal protein (cry2A) gene, complete cds" Jul. 25, 2016.

Cry2Afl GenBank Accession No. AB030519 "Crematogaster borneensis mitochondrial COI gene for cytochrome oxidase subunit I, partial cds, isolate:aL1" Jul. 26, 2016.

Cry2Agl GenBank Accession No. ACH91610 "Cry2Ag [Bacillus thuringiensis]" Jul. 2, 2010.

Cry2Ah2 GenBank Accession No. ACL80665 "Cry2Ah2 [Bacillus thuringiensis]" Jan. 19, 2009.

Cry2Ah3 GenBank Accession No. GU073380 "*Bacillus thuringiensis* strain HYW-8 delta-endotoxin (cry2A) gene, complete cds" Dec. 30, 2012.

Cry2Ah4 GenBank Accession No. KC156702 "*Bacillus thuringiensis* strain ARP193 pesticidal protein gene, complete cds" Nov. 14, 2013.

Cry2Ahl GenBank Accession No. EU939453 "*Bacillus thuringiensis* strain BTSC6H8 cry2-like protein gene, complete cds" Dec. 30, 2011.

Cry2Ail GenBank Accession No. FJ788388 "*Bacillus thuringiensis* strain T 20 Cry2A (cry2A) gene, complete cds" Mar. 1, 2012.

Cry2Akl GenBank Accession No. KC156660 "*Bacillus thuringiensis* strain ARP067 pesticidal protein gene, complete cds" Nov. 14, 2013.

Cry2Bal GenBank Accession No. KC156658 "*Bacillus thuringiensis* strain ARP026 pesticidal protein gene, complete cds" Nov. 14, 2013.

Cry30Aal GenBank Accession No. CAC80986 "Cry30Aa protein [Bacillus thuringiensis serovar medellin]" Jan. 13, 2006.

Cry30Bal GenBank Accession No. BAD00052 "putative mosquitocidal toxin [Bacillus thuringiensis serovar entomocidus]" Oct. 5, 2006.

Cry30Ca2 GenBank Accession No. ACU24781 "Cry30Ca [Bacillus thuringiensis serovar jegathesan]" May 10, 2013.

Cry30Cal GenBank Accession No. BAD67157 "Cry30-like [Bacillus thuringiensis]" Oct. 28, 2004.

Cry30Dal GenBank Accession No. EF095955 "*Bacillus thuringiensis* strain y41 Cry30-like protein gene, complete cds" Dec. 29, 2009.

Cry30Dbl GenBank Accession No. BAE80088 "delta-endotoxin [Bacillus thuringiensis serovar aizawai]" Mar. 1, 2006.

Cry30Ea2 GenBank Accession No. FJ499389 "*Bacillus thuringiensis* strain Ywc2-8 pesticidal crystal protein (cry30) gene, complete cds" Jun. 1, 2011.

Cry30Eal GenBank Accession No. ACC95445 "Cry 30Ea1 [Bacillus thuringiensis]" Mar. 1, 2009.

Cry30Fal GenBank Accession No. ACI22625 "Cry30-like protein [Bacillus thuringiensis]" Jun. 1, 2009.

Cry30Ga2 GenBank Accession No. HQ638217 "*Bacillus thuringiensis* strain S2160-1 Cry30-like protein gene, complete cds" Jun. 25, 2012.

Cry30Gal GenBank Accession No. ACG60020 "Cry30-like protein [Bacillus thuringiensis]" Aug. 13, 2008.

Cry31Aa2 GenBank Accession No. AAL87458 "83-KDa crystal protein [Bacillus thuringiensis]" Jun. 21, 2007.

Cry31Aa3 GenBank Accession No. BAE79808 "Cry31-like 81-kDa protein [Bacillus thuringiensis]" Feb. 23, 2006.

Cry31Aa4 GenBank Accession No. BAF32571 "hypothetical protein [Bacillus thuringiensis]" Sep. 21, 2006.

Cry31Aa5 GenBank Accession No. BAF32572 "hypothetical protein [Bacillus thuringiensis]" Sep. 20, 2006.

Cry31Aa6 GenBank Accession No. BAI44026 "M019CP78A (plasmid) [Bacillus thuringiensis]" Jul. 24, 2016.

Cry31Aal GenBank Accession No. BAB11757 "81-kDa leukemia toxin [Bacillus thuringiensis]" Aug. 12, 2000.

Cry31Ab2 GenBank Accession No. BAF32570 "hypothetical protein [Bacillus thuringiensis]" Sep. 20, 2006.

Cry31Abl GenBank Accession No. BAE79809 "Cry31-like 82-kDa protein [Bacillus thuringiensis]" Feb. 23, 2006.

(56) References Cited

OTHER PUBLICATIONS

Cry31Ac2 GenBank Accession No. AB731600 "Bacillus thuringiensis gene for parasporin 1 like protein, complete cds" May 24, 2013.

Cry31Acl GenBank Accession No. BAF34368 "hypothetical protein [Bacillus thuringiensis]" Oct. 7, 2006.

Cry31Adl GenBank Accession No. BAI44022 "M019CP78B (plasmid) [Bacillus thuringiensis]" Jul. 24, 2016.

Cry32Aa2 GenBank Accession No. GU063849 "Bacillus thuringiensis strain FBG-1 delta-endotoxin (cry32A) gene, complete cds" Dec. 30, 2012.

Cry32Aal GenBank Accession No. AAG36711 "crystal protein [Bacillus thuringiensis serovar yunnanensis]" Jan. 4, 2002.

Cry32Abl GenBank Accession No. GU063850 "Bacillus thuringiensis strain FZ-2 delta-endotoxin (cry32A) gene, complete cds" Dec. 30, 2012.

Cry32Bal GenBank Accession No. BAB78601 "crystal protein CryE6L [Bacillus thuringiensis]" Dec. 6, 2001.

Cry32Cal GenBank Accession No. BAB78602 "crystal protein CryE6Q [Bacillus thuringiensis]" Dec. 6, 2001.

Cry32Cbl GenBank Accession No. KC156708 "Bacillus thuringiensis strain ARP227 pesticidal protein gene, complete cds" Nov. 14, 2013.

Cry32Dal GenBank Accession No. BAB78603 crystal protein CryE6S [Bacillus thuringiensis], Dec. 6, 2001.

Cry32Ea2 GenBank Accession No. KC156686 "Bacillus thuringiensis strain ARP239 pesticidal protein gene, complete cds" Nov. 14, 2013.

Cry32Eal GenBank Accession No. GU324274 "Bacillus thuringiensis strain HYD-3 Cry32 gene, complete cds" Dec. 31, 2012.

Cry32Ebl GenBank Accession No. KC156663 "Bacillus thuringiensis strain ARP092 pesticidal protein gene, complete cds" Nov. 14, 2013.

Cry32Fal GenBank Accession No. KC156656 "Bacillus thuringiensis strain ARP055 pesticidal protein gene, complete cds" Nov. 14, 2013.

Cry32Gal GenBank Accession No. KC156657 "Bacillus thuringiensis strain ARP052 pesticidal protein gene, complete cds" Nov. 14, 2013.

Cry32Hal GenBank Accession No. KC156661 "Bacillus thuringiensis strain ARP076 pesticidal protein gene, complete cds" Nov. 14, 2013.

Cry32Hbl GenBank Accession No. KC156666 "Bacillus thuringiensis strain ARP096 pesticidal protein gene, complete cds" Nov. 14, 2013.

Cry32lal GenBank Accession No. KC156667 "Bacillus thuringiensis strain ARP104 pesticidal protein gene, complete cds" Nov. 14, 2013.

Cry32Jal GenBank Accession No. KC156685 "Bacillus thuringiensis strain ARP262 pesticidal protein gene, complete cds" Nov. 14, 2013.

Cry32Kal GenBank Accession No. KC156688 "Bacillus thuringiensis strain ARP259 pesticidal protein gene, complete cds" Nov. 14, 2013.

Cry32Lal GenBank Accession No. KC156689 "Bacillus thuringiensis strain ARP203 pesticidal protein gene, complete cds" Nov. 14, 2013.

Cry32Mal GenBank Accession No. KC156690 "Bacillus thuringiensis strain ARP256 pesticidal protein gene, complete cds" Nov. 14, 2013.

Cry32Mbl GenBank Accession No. KC156704 "Bacillus thuringiensis strain ARP242 pesticidal protein gene, complete cds" Nov. 14, 2013.

Cry32Nal GenBank Accession No. KC156691 "Bacillus thuringiensis strain ARP179 pesticidal protein gene, complete cds" Nov. 14, 2013.

Cry32Oal GenBank Accession No. KC156703 "Bacillus thuringiensis strain ARP218 pesticidal protein gene, complete cds" Nov. 14, 2013.

Cry32Pal GenBank Accession No. KC156705 "Bacillus thuringiensis strain ARP277 pesticidal protein gene, complete cds" Nov. 14, 2013.

Cry32Qal GenBank Accession No. KC156706 "Bacillus thuringiensis strain ARP174 pesticidal protein gene, complete cds" Nov. 14, 2013.

Cry32Ral GenBank Accession No. KC156707 "Bacillus thuringiensis strain ARP229 pesticidal protein gene, complete cds" Nov. 14, 2013.

Cry32Sal GenBank Accession No. KC156709 "Bacillus thuringiensis strain ARP185 pesticidal protein gene, complete cds" Nov. 14, 2013.

Cry32Tal GenBank Accession No. KC156710 "Bacillus thuringiensis strain ARP220 pesticidal protein gene, complete cds" Nov. 14, 2013.

Cry32Ual GenBank Accession No. KC156655 "Bacillus thuringiensis strain ARP050 pesticidal protein gene, complete cds" Nov. 14, 2013.

Cry33Aal GenBank Accession No. AAL26871 "crystal protein NT40KD [Bacillus thuringiensis serovar dakota]" Apr. 10, 2003.

Cry34Aa2 GenBank Accession No. AAK64560 "crystal protein ET74 [Bacillus thuringiensis]" Jan. 30, 2006.

Cry34Aa3 GenBank Accession No. AAT29032 "14 kDa component of binary insecticidal crystal protein [Bacillus thuringiensis]" Apr. 6, 2005.

Cry34Aa4 GenBank Accession No. AAT29030 "14 kDa component of binary insecticidal crystal protein [Bacillus thuringiensis]" Apr. 6, 2005.

Cry34Aal GenBank Accession No. AAG50341 "13.6 kDa insecticidal crystal protein [Bacillus thuringiensis]" Jan. 11, 2007.

Cry34Abl GenBank Accession No. AAG41671 "13.6 kDa insecticidal crystal protein [Bacillus thuringiensis]" Sep. 26, 2002.

Cry34Ac2 GenBank Accession No. AAK64562 "crystal protein ET79 [Bacillus thuringiensis]" Jan. 30, 2006.

Cry34Ac3 GenBank Accession No. AAT29029 "14 kDa component of binary insecticidal crystal protein [Bacillus thuringiensis]" Apr. 6, 2005.

Cry34Acl GenBank Accession No. AAG50118 "13.6 kDa insecticidal crystal protein [Bacillus thuringiensis]" Mar. 4, 2002.

Cry34Ba2 GenBank Accession No. AAT29033 "14 kDa component of binary insecticidal crystal protein [Bacillus thuringiensis]" Apr. 6, 2005.

Cry34Ba3 GenBank Accession No. AAT29031 "14 kDa component of binary insecticidal crystal protein [Bacillus thuringiensis]" Apr. 6, 2005.

Cry34Bal GenBank Accession No. AAK64565 "crystal protein ET80 [Bacillus thuringiensis]" Jan. 30, 2006.

Cry35Aa2 GenBank Accession No. AAK64561 "crystal protein ET39 [Bacillus thuringiensis]" Jan. 30, 2006.

Cry35Aa3 GenBank Accession No. AAT29028 "44 kDa component of binary insecticidal crystal protein [Bacillus thuringiensis]" Apr. 6, 2005.

Cry35Aa4 GenBank Accession No. AAT29025 "44 kDa component of binary insecticidal crystal protein [Bacillus thuringiensis]" Apr. 6, 2005.

Cry35Aal GenBank Accession No. AAG50342 "43.8 kDa insecticidal crystal protein [Bacillus thuringiensis]" Jan. 11, 2007.

Cry35Ab2 GenBank Accession No. AAK64563 "crystal protein ET71 [Bacillus thuringiensis]" Jan. 30, 2006.

Cry35Ab3 GenBank Accession No. AY536891 "Bacillus thuringiensis strain KR1369 44 kDa component of binary insecticidal crystal protein (cry35A) gene, complete cds" Apr. 6, 2005.

Cry35Abl GenBank Accession No. AAG41672 "43.8 kDa insecticidal crystal protein [Bacillus thuringiensis]" Sep. 26, 2002.

Cry35Acl GenBank Accession No. AAG50117 "43.8 kDa insecticidal crystal protein [Bacillus thuringiensis]" Mar. 4, 2002.

Cry35Ba2 GenBank Accession No. AAT29027 "44 kDa component of binary insecticidal crystal protein [Bacillus thuringiensis]" Apr. 6, 2005.

Cry35Ba3 GenBank Accession No. AAT29026 "44 kDa component of binary insecticidal crystal protein [Bacillus thuringiensis]" Apr. 6, 2005.

(56) References Cited

OTHER PUBLICATIONS

Cry35Bal GenBank Accession No. AAK64566 "crystal protein ET76 [Bacillus thuringiensis]" Jan. 30, 2006.

Cry36Aal GenBank Accession No. AAK64558 "crystal protein ET69 [Bacillus thuringiensis]" Jun. 26, 2001.

Cry37 Aal GenBank Accession No. AAF76376 "crystal protein [Bacillus thuringiensis]" Jun. 16, 2000.

Cry38Aal GenBank Accession No. AAK64559 "crystal protein ET75 [Bacillus thuringiensis]" Jan. 30, 2006.

Cry39Aal GenBank Accession No. BAB72016 "mosquitocidal toxin, partial [Bacillus thuringiensis serovar aizawai]" Jul. 26, 2016.

Cry3Aa10 GenBank Accession No. AAU29411 "Cry3Aa protein [Bacillus thuringiensis]" Apr. 29, 2005.

Cry3Aa12 GenBank Accession No. ABY49136 "Cry3A [Bacillus thuringiensis serovar tenebrionis]" Jan. 1, 2008.

Cry3Aa2 GenBank Accession No. AAA22541 "insecticidal crystal protein [Bacillus thuringiensis]" Apr. 26, 1993.

Cry3Aa3 GenBank Accession No. CAA68482 "unnamed protein product [Bacillus thuringiensis]" Apr. 18, 2005.

Cry3Aa4 GenBank Accession No. AAA22542 "insect control protein [Bacillus thuringiensis]" Apr. 26, 1993.

Cry3Aa5 GenBank Accession No. AAA50255 "crystal protein [Bacillus thuringiensis serovar morrisoni]" Feb. 27, 2002.

Cry3Aa6 GenBank Accession No. AAC43266 "CryIIIA [Bacillus thuringiensis serovar tenebrionis]" Dec. 9, 1994.

Cry3Aa7 GenBank Accession No. CAB41411 "Cry3Aa protein [Bacillus thuringiensis]" Apr. 15, 2005.

Cry3Aa8 GenBank Accession No. AAS79487 "insecticidal crystal protein [Bacillus thuringiensis]" Apr. 6, 2004.

Cry3Aa9 GenBank Accession No. AAW05659 "Sequence 2 from U.S. Pat. No. 6,797,490" Dec. 15, 2004.

Cry3Aal GenBank Accession No. AAA22336 "delta-endotoxin, partial [Bacillus thuringiensis]" Apr. 26, 1993.

Cry3Aall GenBank Accession No. AAW82872 "Cry3 delta endotoxin [Bacillus thuringiensis serovar tenebrionis]" Feb. 14, 2005.

Cry3Ba2 GenBank Accession No. CAA00645 "toxin [Bacillus thuringiensis]" Apr. 14, 2005.

Cry3Ba3 GenBank Accession No. JQ397327 "Bacillus thuringiensis strain ML090 delta-endotoxin Cry3Ba3 (cry3Ba3) gene, complete cds" Jan. 10, 2016.

Cry3Bal GenBank Accession No. CAA34983 "unnamed protein product, partial [Bacillus thuringiensis]" Jul. 26, 2016.

Cry3Bb2 GenBank Accession No. AAA74198 "Cry3Bb2 [Bacillus thuringiensis]" Aug. 10, 1995.

Cry3Bb3 GenBank Accession No. I15475 "Sequence 2 from U.S. Pat. No. 5,466,597" Apr. 2, 1996.

Cry3Bbl GenBank Accession No. AAA22334 "cryIIIB2 [Bacillus thuringiensis]" Apr. 26, 1993.

Cry3Cal GenBank Accession No. CAA42469 "CryIIID [Bacillus thuringiensis serovar kurstaki]" Apr. 18, 2005.

Cry40Aal GenBank Accession No. BAB72018 "putative mosquitocidal toxin, partial [Bacillus thuringiensis serovar aizawai]" Jul. 26, 2016.

Cry40Bal GenBank Accession No. BAC77648 "putative mosquitocidal toxin [Bacillus thuringiensis serovar aizawai]" Jun. 14, 2003.

Cry40Cal GenBank Accession No. EU381045 "Bacillus thuringiensis strain BTY41 cry40-like protein gene, complete cds" Dec. 1, 2011.

Cry40Dal GenBank Accession No. ACF15199 "toxin protein [Bacillus thuringiensis]" Apr. 1, 2009.

Cry41Aal GenBank Accession No. BAD35157 "cancer cell-killing Cry protein parasporin-3 [Bacillus thuringiensis]" Jan. 20, 2006.

Cry41Abl GenBank Accession No. BAD35163 "cancer cell-killing Cry protein [Bacillus thuringiensis]" Jan. 20, 2006.

Cry41Ba2 GenBank Accession No. ZP_04099652 "Cancer cell-killing Cry protein [Bacillus thuringiensis serovar andalousiensis Bgsc 4AW1]" Nov. 27, 2012.

Cry41 Bal GenBank Accession No. HM461871 "Bacillus thuringiensis strain Sbt021 parasporin 3-like protein (cry0212) gene, complete cds" Dec. 31, 2013.

Cry42Aal GenBank Accession No. BAD35166 "Cry protein [Bacillus thuringiensis]" Aug. 10, 2004.

Cry43Aa2 GenBank Accession No. BAD95474 "Cryhime1 [Paenibacillus popilliae]" Apr. 9, 2005.

Cry43Aal GenBank Accession No. BAD15301 "parasporal crystal protein [Paenibacillus lentimorbus]" Jul. 26, 2016.

Cry43Bal GenBank Accession No. BAD15303 "parasporal crystal protein [Paenibacillus lentimorbus]" Jul. 26, 2016.

Cry43Cal GenBank Accession No. KC156676 "Brevibacillus laterosporus strain ARP132 pesticidal protein gene, complete cds" Nov. 14, 2013.

Cry43Cbl GenBank Accession No. KC156695 "Brevibacillus laterosporus strain ARP252 pesticidal protein gene, complete cds" Nov. 14, 2013.

Cry43Ccl GenBank Accession No. KC156696 "Brevibacillus laterosporus strain ARP191 pesticidal protein gene, complete cds" Nov. 14, 2013.

Cry43-like GenBank Accession No. BAD15305 "parasporal crystal protein, partial [Paenibacillus lentimorbus]" Jul. 26, 2016.

Cry44Aa GenBank Accession No. BAD08532 "putative mosquitocidal toxin [Bacillus thuringiensis serovar entomocidus]" Feb. 22, 2008.

Cry45Aa GenBank Accession No. BAD22577 "parasporin 1470D [Bacillus thuringiensis serovar shandongiensis]" May 26, 2006.

Cry46Aa GenBank Accession No. BAC79010 "crystal protein [Bacillus thuringiensis serovar dakota]" Oct. 5, 2006.

Cry46Aa2 GenBank Accession No. BAG68906 "parasporin2 [Bacillus thuringiensis serovar shandongiensis]" Oct. 24, 2013.

Cry46Ab GenBank Accession No. BAD35170 "crystal protein (plasmid) [Bacillus thuringiensis]" Jul. 26, 2016.

Cry47 Aa GenBank Accession No. AAY24695 "Cry [Bacillus thuringiensis]" Oct. 24, 2005.

Cry48Aa GenBank Accession No. CAJ18351 "Crystal toxin [Lysinibacillus sphaericus]" Jul. 26, 2016.

Cry48Aa2 GenBank Accession No. CAJ86545 "Cry48Aa protein [Lysinibacillus sphaericus]" Aug. 31, 2007.

Cry48Aa3 GenBank Accession No. CAJ86546 "Cry48Aa protein [Lysinibacillus sphaericus]" Aug. 31, 2007.

Cry48Ab GenBank Accession No. CAJ86548 "Cry48Aa protein, partial [Lysinibacillus sphaericus]" Jul. 26, 2016.

Cry48Ab2 GenBank Accession No. CAJ86549 "Cry48Aa protein, partial [Lysinibacillus sphaericus]" Jul. 26, 2016.

Cry49Aa GenBank Accession No. CAH56541 "Crystal toxin [Lysinibacillus sphaericus]" Jul. 26, 2016.

Cry49Aa2 GenBank Accession No. CAJ86541 "Cry49Aa protein [Lysinibacillus sphaericus]" Aug. 31, 2007.

Cry49Aa3 GenBank Accession No. CAJ86543 "Cry49Aa protein [Lysinibacillus sphaericus]" Aug. 31, 2007.

Cry49Aa4 GenBank Accession No. CAJ86544 "Cry49Aa protein [Lysinibacillus sphaericus]" Aug. 31, 2007.

Cry49Abl GenBank Accession No. CAJ86542 "Cry49Aa protein [Lysinibacillus sphaericus]" Aug. 31, 2007.

Cry4Aa2 GenBank Accession No. BAA00179 "130 kDa insecticidal protein (ISRH4) (plasmid) [Bacillus thuringiensis serovar israelensis]" Jul. 26, 2016.

Cry4Aa3 GenBank Accession No. CAD30148 "pesticidial crystal protein cry4AA (plasmid) [Bacillus thuringiensis serovar israelensis]" Oct. 23, 2008.

Cry4Aa4 GenBank Accession No. AFB18317 "putative cry4A [Bacillus thuringiensis serovar israelensis]" Feb. 21, 2012.

Cry4Aal GenBank Accession No. CAA68485 "unnamed protein product [Bacillus thuringiensis]" Apr. 18, 2005.

Cry4A-like GenBank Accession No. AAY96321 "cry4A insecticidal protein, partial [Bacillus thuringiensis]" Jul. 26, 2016.

Cry4Ba2 GenBank Accession No. CAA30114 "unnamed protein product [Bacillus thuringiensis]" Apr. 18, 2005.

Cry4Ba3 GenBank Accession No. AAA22337 "mosquitocidal protein [Bacillus thuringiensis]" Apr. 26, 1993.

Cry4Ba4 GenBank Accession No. BAA00178 "130 kDa insecticidal protein (ISRH3) (plasmid) [Bacillus thuringiensis serovar israelensis]" Jul. 26, 2016.

Cry4Ba5 GenBank Accession No. CAD30095 "pesticidial crystal protein cry4BA (plasmid) [Bacillus thuringiensis serovar israelensis]" Oct. 23, 2008.

Cry4Bal GenBank Accession No. CAA30312 "unnamed protein product [Bacillus thuringiensis]" Oct. 23, 2008.

(56)         References Cited

OTHER PUBLICATIONS

Cry4Ba-like GenBank Accession No. ABC47686 "pesticidal crystal protein cry4B-like [Bacillus thuringiensis]" Dec. 22, 2005.

Cry4Cal GenBank Accession No. EU646202 "*Bacillus thuringiensis* strain BTy41 Cry4-like protein gene, complete cds" Dec. 20, 2011.

Cry4Cb2 GenBank Accession No. FJ597622 "*Bacillus thuringiensis* strain Ywc2-8 pesticidal crystal protein (cry4C) gene, complete cds" Jun. 1, 2011.

Cry4Cbl GenBank Accession No. FJ403208 "*Bacillus thuringiensis* strain HS18-1 pesticidal crystal protein (cry4Da1) gene, complete cds" Apr. 3, 2010.

Cry4Ccl GenBank Accession No. FJ403207 "*Bacillus thuringiensis* strain BtMC282 pesticidal crystal protein (cry4Db) gene, complete cds" Jun. 1, 2011.

Cry50Aal GenBank Accession No. BAE86999 "pesticidal crystal protein [Bacillus thuringiensis serovar sotto]" Mar. 16, 2006.

Cry50Ba2 GenBank Accession No. GU446676 "*Bacillus thuringiensis* strain S3161-3 Cry50-like protein gene, complete cds" Feb. 1, 2011.

Cry50Bal GenBank Accession No. GU446675 "*Bacillus thuringiensis* strain S2160-1 Cry50-like protein gene, complete cds" Jun. 25, 2012.

Cry51Aa2 GenBank Accession No. GU570697 "*Bacillus thuringiensis* strain EG2934 parasporal crystal protein gene, complete cds" May 16, 2012.

Cry51Aal GenBank Accession No. AB114444 "Marsupenaeus japonicus con mRNA for crustocalcin-a, complete cds" Dec. 4, 2004.

Cry52Aal GenBank Accession No. EF613489 "Bacillus thuringiensis Cry19-like protein gene, complete cds" Dec. 31, 2010.

Cry52Bal GenBank Accession No. FJ361760 "*Bacillus thuringiensis* strain Bm59-2 pesticidal crystal protein (cry53Ba) gene, partial cds" Jul. 24, 2016.

Cry53Aal GenBank Accession No. EF633476 "*Bacillus thuringiensis* strain Y41 Cry toxin (cry) gene, complete cds" Dec. 30, 2010.

Cry53Abl GenBank Accession No. FJ361759 "*Bacillus thuringiensis* strain Btmc28 pesticidal crystal protein (cry52Ab) gene, partial cds" Jul. 24, 2016.

Cry54Aa2 GenBank Accession No. GQ140349 "*Bacillus thuringiensis* strain FBG25 Cry54 (cry54) gene, complete cds" Dec. 22, 2012.

Cry54Aal GenBank Accession No. ACA52194 "insecticidal crystal protein Cry54Aa [Bacillus thuringiensis]" Jun. 1, 2009.

Cry54Abl GenBank Accession No. JQ916908 "*Bacillus thuringiensis* strain BtMC28 cry-like protein gene, partial cds; and hypothetical protein gene, complete cds" Jan. 1, 2016.

Cry54Bal GenBank Accession No. GU446677 "*Bacillus thuringiensis* strain S2160-1 Cry54-like protein gene, complete cds" Jun. 25, 2012.

Cry55Aa2 GenBank Accession No. AAE33526 "Sequence 7 from U.S. Pat. No. 5,973,231" Aug. 31, 2000.

Cry55Aal GenBank Accession No. ABW88932 "Cry1518-45 [Bacillus thuringiensis YBT-1518]" Nov. 17, 2008.

Cry56Aa2 GenBank Accession No. GQ483512 "*Bacillus thuringiensis* strain G7-1 Cry56Aa-like protein gene, complete cds" Jun. 1, 2011.

Cry56Aa3 GenBank Accession No. JX025567 "*Bacillus thuringiensis* strain HS18-1 Cry56Aa1-like protein gene, complete cds" May 7, 2016.

Cry56Aal GenBank Accession No. ACU57499 "pesticidal crystal protein [Bacillus thuringiensis]" Feb. 3, 2010.

Cry57Aal GenBank Accession No. ANC87261 "tRNA pseudouridine(55) synthase TruB [*Sphingomonas* sp. NIC1]" Feb. 28, 2017.

Cry58Aal GenBank Accession No. ANC87260 "30S ribosomal protein S15 [*Sphingomonas* sp. NIC1]" Feb. 28, 2017.

Cry59Aal GenBank Accession No. ACR43758 "cry4 delta-toxin-like protein (plasmid) [Bacillus thuringiensis]" Jul. 24, 2016.

Cry59Bal GenBank Accession No. JN790647 "*Bacillus thuringiensis* strain Bm59-2 cry4-like protein gene, complete cds" Sep. 26, 2015.

Cry5Aal GenBank Accession No. AAA67694 "delta-endotoxin, partial [Bacillus thuringiensis serovar darmstadiensis]" May 30, 1995.

Cry5Abl GenBank Accession No. AAA67693 "delta-endotoxin, partial [Bacillus thuringiensis serovar darmstadiensis]" May 30, 1995.

Cry5Acl GenBank Accession No. 134543 "Sequence 42 from U.S. Pat. No. 5,596,071" Feb. 6, 1997.

Cry5Adl GenBank Accession No. ABQ82087 "CryAd [Bacillus thuringiensis]" Jul. 23, 2016.

Cry5Ba2 GenBank Accession No. ABW88931 "Cry5B-like protein [Bacillus thuringiensis YBT-1518]" Nov. 17, 2008.

Cry5Ba3 GenBank Accession No. AFJ04417 Cry5B-like delta endotoxin [Bacillus thuringiensis] May 8, 2012.

Cry5Bal GenBank Accession No. AAA68598 "delta endotoxin, partial [Bacillus thuringiensis]" Jun. 21, 1995.

Cry5Ca2 GenBank Accession No. ZP_04123426 "Pesticidal crystal protein cry5Ba [Bacillus thuringiensis serovar pakistani str. T13001]" Nov. 27, 2012.

Cry5Cal GenBank Accession No. HM461869 "*Bacillus thuringiensis* strain Sbt003 nematicidal crystal protein (cry0031) gene, complete cds" Dec. 31, 2013.

Cry5Da2 GenBank Accession No. ZP_04123980 "Pesticidal crystal protein cry5Ba [Bacillus thuringiensis serovar pakistani str. T13001]" Nov. 27, 2012.

Cry5Dal GenBank Accession No. HM461870 "*Bacillus thuringiensis* strain Sbt003 Cry0032 (cry0032) gene, complete cds" Dec. 31, 2013.

Cry5Ea2 GenBank Accession No. ZP_04124038 "Pesticidal crystal protein cry5Aa [Bacillus thuringiensis serovar pakistani str. T13001]" Nov. 27, 2012.

Cry5Eal GenBank Accession No. HM485580 "*Bacillus thuringiensis* strain Sbt003 Cry0033 gene, complete cds" Dec. 31, 2019.

Cry60Aa2 GenBank Accession No. EA057254 "Sequence 628 from U.S. Pat. No. 7,166,424" Feb. 7, 2007.

Cry60Aa3 GenBank Accession No. EEM99278 "Pesticidial crystal protein cry15Aa [Bacillus thuringiensis IBL 4222]" Apr. 30, 2009.

Cry60Aal GenBank Accession No. ACU24782 "Cry [Bacillus thuringiensis serovar jegathesan]" May 10, 2013.

Cry60Ba2 GenBank Accession No. EA057253 "Sequence 626 from U.S. Pat. No. 7,166,424" Feb. 7, 2007.

Cry60Ba3 GenBank Accession No. EEM99279 "Pesticidial crystal protein cry15Aa [Bacillus thuringiensis IBL 4222]" Apr. 30, 2009.

Cry60Bal GenBank Accession No. GU810818 "Bacillus thuringiensis serovar malayensis strain 4AV1 crystal protein gene, complete cds" Apr. 3, 2010.

Cry61Aa2 GenBank Accession No. HM132125 "*Bacillus thuringiensis* strain HD868(E5) Cry7-like protein gene, partial cds" Jul. 25, 2016.

Cry61Aa3 GenBank Accession No. EEM19308 "hypothetical protein bthur0001_55730 [Bacillus thuringiensis serovar tochigiensis Bgsc 4Y1]" Apr. 30, 2009.

Cry61Aal GenBank Accession No. HM035087 "*Bacillus thuringiensis* strain Sbt009 pesticidal crystal protein Cry0092 (cry0092) gene, complete cds" Dec. 31, 2013.

Cry62Aal GenBank Accession No. HM054509 "*Bacillus thuringiensis* strain ST7 insecticidal and cancer cell-killing Cry protein (cry62Aa1) gene, complete cds" Dec. 30, 2013.

Cry63Aal GenBank Accession No. BAI44028 "M019CP84 (plasmid) [Bacillus thuringiensis]" Jul. 24, 2016.

Cry64Aal GenBank Accession No. BAJ05397 "crystal protein [Bacillus thuringiensis]" Jul. 10, 2014.

Cry65Aa2 GenBank Accession No. ZP_04123838 "Cancer cell-killing Cry protein [Bacillus thuringiensis serovar pakistani str. T13001]" Nov. 27, 2012.

Cry65Aal GenBank Accession No. HM461868 "Bacillus thuringiensis strain Sbt003 parasporin-like protein (cry0034) and Cry0034C (cry0034C) genes, complete cds" Dec. 31, 2013.

Cry66Aa2 GenBank Accession No. ZP_04099945 "hypothetical protein bthur0009_56320 [Bacillus thuringiensis serovar andalousiensis Bgsc 4AW1]" Nov. 27, 2012.

Cry66Aal GenBank Accession No. HM485581 "*Bacillus thuringiensis* strain Sbt021 Cry0211 gene, complete cds" Dec. 31, 2019.

Cry67Aa2 GenBank Accession No. ZP_04148882 "Pesticidal crystal protein cry4Aa [Bacillus thuringiensis serovar tochigiensis Bgsc 4Y1]" Nov. 27, 2012.

(56) References Cited

OTHER PUBLICATIONS

Cry67Aal GenBank Accession No. HM485582 "*Bacillus thuringiensis* strain Sbt009 Cry0094 gene, complete cds" Dec. 31, 2019.

Cry68Aal GenBank Accession No. HQ113114 "Bacillus thuringiensis Cry20-like protein (cry20) gene, complete cds" Dec. 30, 2012.

Cry69Aa2 GenBank Accession No. JQ821388 "*Bacillus thuringiensis* strain BtMC28 Cry69Aa-like protein gene, complete cds" Jan. 1, 2016.

Cry69Aal GenBank Accession No. HQ401006 "*Bacillus thuringiensis* strain BtMC28 Cry-like protein (cry) gene, complete cds" Nov. 1, 2013.

Cry69Abl GenBank Accession No. JN209957 "*Bacillus thuringiensis* strain hs18-1 insecticidal Cry-like protein (cry) gene, complete cds" Jul. 1, 2015.

Cry6Aa2 GenBank Accession No. AAM46849 "nematocidal crystal protein R1 [Bacillus thuringiensis YBT-1518]" Dec. 23, 2009.

Cry6Aa3 GenBank Accession No. ABH03377 "nematocidal crystal protein 6A [Bacillus thuringiensis]" Aug. 5, 2006.

Cry6Aal GenBank Accession No. AAA22357 "delta-endotoxin, partial [Bacillus thuringiensis]" Apr. 26, 1993.

Cry6Bal GenBank Accession No. AAA22358 "delta-endotoxin, partial [Bacillus thuringiensis]" Apr. 26, 1993.

Cry7 Aal GenBank Accession No. AAA22351 "crystal protein [Bacillus thuringiensis serovar galleriae]" Apr. 26, 1993.

Cry7 Ab4 GenBank Accession No. EU380678 "*Bacillus thuringiensis* strain HQ122 cry7-like protein gene, complete cds" Feb. 1, 2011.

Cry7 Ab5 GenBank Accession No. ABX79555 "crystal Cry7-like protein (plasmid) [Bacillus thuringiensis serovar monterrey]" Jul. 26, 2016.

Cry7 Ab6 GenBank Accession No. ACI44005 "insecticidal crystal protein [Bacillus thuringiensis]" Oct. 15, 2008.

Cry7 Ab7 GenBank Accession No. ADB89216 "insecticidal crystal protein Cry7Ab [Bacillus thuringiensis]" Jul. 1, 2010.

Cry7 Ab8 GenBank Accession No. GU145299 "*Bacillus thuringiensis* strain GWS7 Cry7Ab8 protein (cry7Ab8) gene, complete cds" Nov. 11, 2009.

Cry70Aal GenBank Accession No. JN646781 "*Bacillus thuringiensis* strain HS18-1 cry-like protein gene, complete cds" Sep. 26, 2015.

Cry70Bal GenBank Accession No. ADO51070 "cry protein [Bacillus thuringiensis]" Jun. 1, 2011.

Cry70Bbl GenBank Accession No. EEL67276 "83-kDa crystal protein [Bacillus mycoides]" Jun. 25, 2018.

Cry71Aal GenBank Accession No. JX025568 "*Bacillus thuringiensis* strain HS18-1 Cry53Ab1-like protein gene, complete cds" May 7, 2016.

Cry72Aal GenBank Accession No. JX025569 "*Bacillus thuringiensis* strain HS18-1 mosquitocidal toxin-like protein gene, complete cds" May 7, 2016.

Cry7Ab2 GenBank Accession No. AAA21121 "CryIII delta-endotoxin, partial [Bacillus thuringiensis serovar kumamtoensis]" Aug. 27, 1994.

Cry7Ab3 GenBank Accession No. ABX24522 "Cry7Ab3 delta-endotoxin [Bacillus thuringiensis]" Sep. 11, 2008.

Cry7Ab9 GenBank Accession No. ADD92572 "insecticidal crystal protein [Bacillus thuringiensis]" Mar. 27, 2010.

Cry7Abl GenBank Accession No. AAA21120 "CryIII delta-endotoxin, partial [Bacillus thuringiensis serovar dakota]" Aug. 27, 1994.

Cry7Bal GenBank Accession No. # ABB70817 "insecticidal crystal protein Cry7Ba1 [Bacillus thuringiensis serovar huazhongensis]" Nov. 1, 2006.

Cry7Bbl GenBank Accession No. KC156653 "*Bacillus thuringiensis* strain ARP013 pesticidal protein gene, complete cds" Nov. 14, 2013.

Cry7Cal GenBank Accession No. ABR67863 "pesticidal crystal protein [Bacillus thuringiensis]" Dec. 20, 2016.

Cry7Cbl GenBank Accession No. KC156698 "*Bacillus thuringiensis* strain ARP269 pesticidal protein gene, complete cds" Nov. 14, 2013.

Cry7Da2 GenBank Accession No. HM572236 "Bacillus thuringiensis cry7-like protein 2 gene, partial cds" Dec. 30, 2019.

Cry7Da3 GenBank Accession No. KC156679 "*Bacillus thuringiensis* strain ARP140 pesticidal protein gene, complete cds" Nov. 14, 2013.

Cry7Dal GenBank Accession No. ACQ99547 "pesticidal crystal protein, partial [Bacillus thuringiensis]" Jul. 24, 2016.

Cry7Ea2 GenBank Accession No. HM132124 "*Bacillus thuringiensis* strain HD868(D8) Cry7-like protein gene, partial cds" Jul. 25, 2016.

Cry7Ea3 GenBank Accession No. EEM19403 "hypothetical protein bthur0001_54740 [Bacillus thuringiensis serovar tochigiensis BGSC 4Y1]" Apr. 30, 2009.

Cry7Eal GenBank Accession No. HM035086 "*Bacillus thuringiensis* strain Sbt009 pesticidal crystal protein Cry0091 (cry0091) gene, complete cds" Dec. 31, 2013.

Cry7Fa2 GenBank Accession No. EEM19090 "hypothetical protein bthur0001_58040 [Bacillus thuringiensis serovar tochigiensis BGSC 4Y1]" Apr. 30, 2009.

Cry7Fal GenBank Accession No. HM035088 "*Bacillus thuringiensis* strain Sbt009 pesticidal crystal protein Cry0093 (cry0093) gene, complete cds" Dec. 31, 2013.

Cry7Fb2 GenBank Accession No. KC156682 "*Bacillus thuringiensis* strain ARP162 pesticidal protein gene, complete cds" Nov. 14, 2013.

Cry7Fbl GenBank Accession No. HM572235 "Bacillus thuringiensis cry7-like protein 1 gene, partial cds" Dec. 30, 2019.

Cry7Ga2 GenBank Accession No. KC156669 "*Bacillus thuringiensis* strain ARP103 pesticidal protein gene, complete cds" Nov. 14, 2013.

Cry7Gal GenBank Accession No. HM572237 "Bacillus thuringiensis cry7-like protein 3 gene, partial cds" Dec. 30, 2019.

Cry7Gbl GenBank Accession No. KC156650 "*Bacillus thuringiensis* strain ARP011 pesticidal protein gene, complete cds" Nov. 14, 2013.

Cry7Gcl GenBank Accession No. KC156654 "*Bacillus thuringiensis* strain ARP012 pesticidal protein gene, complete cds" Nov. 14, 2013.

Cry7Gdl GenBank Accession No. KC156697 "*Bacillus thuringiensis* strain ARP271 pesticidal protein gene, complete cds" Nov. 14, 2013.

Cry7Hal GenBank Accession No. KC156651 "*Bacillus thuringiensis* strain ARP021 pesticidal protein gene, complete cds" Nov. 14, 2013.

Cry7lal GenBank Accession No. KC156665 "*Bacillus thuringiensis* strain ARP112 pesticidal protein gene, complete cds" Nov. 14, 2013.

Cry7Jal GenBank Accession No. KC156671 "*Bacillus thuringiensis* strain ARP114 pesticidal protein gene, complete cds" Nov. 14, 2013.

Cry7Kal GenBank Accession No. KC156680 "*Bacillus thuringiensis* strain ARP171 pesticidal protein gene, complete cds" Nov. 14, 2013.

Cry7Kbl GenBank Accession No. BAM99306 "155 kDa hypothetical protein delta-endotoxin [Bacillus thuringiensis serovar dakota]" Mar. 14, 2013.

Cry7Lal GenBank Accession No. BAM99307 "131 kDa hypothetical protein, delta-endotoxin [Bacillus thuringiensis serovar dakota]" Mar. 14, 2013.

Cry8Aal GenBank Accession No. AAA21117 "CryIII delta-endotoxin, partial [Bacillus thuringiensis serovar kumamtoensis]" Aug. 27, 1994.

Cry8Abl GenBank Accession No. EU044830 "*Bacillus thuringiensis* strain B-JJX insecticidal crystal protein gene, complete cds" Dec. 31, 2009.

Cry8Acl GenBank Accession No. KC156662 "*Bacillus thuringiensis* strain ARP068 pesticidal protein gene, complete cds" Nov. 14, 2013.

Cry8Adl GenBank Accession No. KC156684 "*Brevibacillus laterosporus* strain ARP215 pesticidal protein gene, complete cds" Nov. 14, 2013.

Cry8Bal GenBank Accession No. AAA21118 "CryIII delta-endotoxin, partial [Bacillus thuringiensis serovar kumamtoensis]" Aug. 27, 1994.

(56)     References Cited

OTHER PUBLICATIONS

Cry8Bbl GenBank Accession No. CAD57542 "unnamed protein product [Bacillus thuringiensis]" Nov. 23, 2002.

Cry8Bcl GenBank Accession No. CAD57543 "unnamed protein product [Bacillus thuringiensis]" Nov. 23, 2002.

Cry8Ca2 GenBank Accession No. AAR98783 "HBF-1 CrylII delta-endotoxin [Bacillus thuringiensis]" Oct. 29, 2007.

Cry8Ca3 GenBank Accession No. EU625349 "*Bacillus thuringiensis* strain FB-32 delta-endotoxin gene, complete cds" May 1, 2011.

Cry8Ca4 GenBank Accession No. ADB54826 "CrylII insecticidal crystal protein [Bacillus thuringiensis]" Jan. 26, 2010.

Cry8Cal GenBank Accession No. AAA21119 "CrylII delta-endotoxin [Bacillus thuringiensis serovar japonensis]" Aug. 27, 1994.

Cry8Da2 GenBank Accession No. BD133574 "Protein having insecticidal activity, DNA encoding the protein, and controlling agent and controlling method of noxious organisms" Sep. 18, 2002.

Cry8Da3 GenBank Accession No. BD133575 "Protein having insecticidal activity, DNA encoding the protein, and controlling agent and controlling method of noxious organisms" Sep. 18, 2002.

Cry8Dal GenBank Accession No. BAC07226 "cry8 [Bacillus thuringiensis serovar galleriae]" Dec. 20, 2003.

Cry8Dbl GenBank Accession No. BAF93483 "Cry8Dlike [Bacillus thuringiensis]" Dec. 6, 2008.

Cry8Ea2 GenBank Accession No. EU047597 "*Bacillus thuringiensis* strain B-DLL crystal protein gene, complete cds" Dec. 30, 2009.

Cry8Ea3 GenBank Accession No. KC855216 "*Bacillus thuringiensis* strain GWL Cry8Ea3 gene, complete cds" Jun. 30, 2015.

Cry8Eal GenBank Accession No. AAQ73470 "Cry8Ea1 [Bacillus thuringiensis]" Mar. 18, 2009.

Cry8Fa2 GenBank Accession No. HQ174208 "*Bacillus thuringiensis* strain B-DLL insecticidal crystal protein (cry8Fa2) gene, complete cds" Oct. 2, 2010.

Cry8Fa3 GenBank Accession No. AFH78109 "Cry8x [Bacillus thuringiensis]" Apr. 21, 2012.

Cry8Fal GenBank Accession No. AAT48690 "Cry8X [Bacillus thuringiensis]" Mar. 18, 2009.

Cry8Ga2 GenBank Accession No. ABC42043 "toxin pbt145-1 [Bacillus thuringiensis]" Dec. 30, 2008.

Cry8Ga3 GenBank Accession No. FJ198072 "*Bacillus thuringiensis* strain FCD114 spherical crystal protein (cry8Ga) gene, complete cds" Aug. 10, 2010.

Cry8Gal GenBank Accession No. AAT46073 "crystal protein [Bacillus thuringiensis]" Sep. 22, 2009.

Cry8Hal GenBank Accession No. AAW81032 "Cry8 [Bacillus thuringiensis]" Jan. 3, 2011.

Cry8Ia2 GenBank Accession No. GU073381 "*Bacillus thuringiensis* strain HW-11 delta-endotoxin (cry8) gene, complete cds" Dec. 30, 2012.

Cry8Ia3 GenBank Accession No. HM044664 "Bacillus thuringiensis Cry0301 (cry0301) gene, complete cds" Dec. 31, 2013.

Cry8Ia4 GenBank Accession No. KC156674 *Bacillus thuringiensis* strain ARP124 pesticidal protein gene, complete cds Nov. 14, 2013.

Cry8Ial GenBank Accession No. EU381044 "*Bacillus thuringiensis* strain btsu4 cry8-like protein gene, complete cds" Feb. 20, 2011.

Cry8Ib2 GenBank Accession No. KC156677 "*Bacillus thuringiensis* strain ARP135 pesticidal protein gene, complete cds" Nov. 14, 2013.

Cry8Ibl GenBank Accession No. GU325772 "*Bacillus thuringiensis* strain F4 Cry8L (cry8L) gene, complete cds" Dec. 30, 2012.

Cry8Jal GenBank Accession No. EU625348 "*Bacillus thuringiensis* strain FPT-2 delta-endotoxin gene, complete cds" May 1, 2011.

Cry8Ka2 GenBank Accession No. ACN87262 "Cry8Ka2 delta-endotoxin (plasmid) [Bacillus thuringiensis serovar kenyae]" Jul. 24, 2016.

Cry8Kal GenBank Accession No. FJ422558 "Bacillus thuringiensis delta-endotoxin (cry8) gene, partial cds" Dec. 26, 2011.

Cry8Kb2 GenBank Accession No. KC156675 "*Bacillus thuringiensis* strain ARP158 pesticidal protein gene, complete cds" Nov. 14, 2013.

Cry8Kbl GenBank Accession No. HM123758 "*Bacillus thuringiensis* strain ST8 Cry8Kb gene, complete cds" Dec. 30, 2013.

Cry8Lal GenBank Accession No. GU325771 "*Bacillus thuringiensis* strain F4 Cry8M (cry8M) gene, complete cds" Dec. 30, 2012.

Cry8-like GenBank Accession No. ABS53003 "crystal protein [Bacillus thuringiensis]" Jul. 30, 2007.

Cry8-like GenBank Accession No. FJ770571 "Bacillus thuringiensis serovar canadensis plasmid cry8b delta-toxin-like gene, complete sequence" Sep. 9, 2010.

Cry8Ma2 GenBank Accession No. EEM86551 "Pesticidal crystal protein cry8Ba [Bacillus thuringiensis serovar pulsiensis Bgsc 4CC1]" Apr. 30, 2009.

Cry8Ma3 GenBank Accession No. HM210574 "*Bacillus thuringiensis* strain NARC Bt17(C6) Cry8-like protein gene, complete cds" Dec. 31, 2013.

Cry8Mal GenBank Accession No. HM044665 "Bacillus thuringiensis Cry0302 (cry0302) gene, complete cds" Dec. 31, 2013.

Cry8Nal GenBank Accession No. HM640939 "*Bacillus thuringiensis* strain Q52-7 Cry8Ga4 (cry8Ga4) gene, complete cds" Jul. 30, 2011.

Cry8Pal GenBank Accession No. HQ388415 "*Bacillus thuringiensis* strain ST8 Cry8-like protein gene, complete cds" Dec. 30, 2013.

Cry8Qa2 GenBank Accession No. KC152468 "*Bacillus thuringiensis* strain INTA Fr7-4 Cry8 gene, complete cds" Dec. 24, 2012.

Cry8Qal GenBank Accession No. HQ441166 "*Bacillus thuringiensis* strain ST8 Cry8-like protein gene, complete cds" Dec. 30, 2013.

Cry8Ral GenBank Accession No. AFP87548 "Cry8-like delta-endotoxin [Bacillus thuringiensis]" Aug. 19, 2012.

Cry8Sal GenBank Accession No. JQ740599 "*Bacillus thuringiensis* strain 62 Cry8Sa1 gene, complete cds" Feb. 14, 2016.

Cry8Tal GenBank Accession No. KC156673 "*Bacillus thuringiensis* strain ARP110 pesticidal protein gene, complete cds" Nov. 14, 2013.

Cry9Aa like GenBank Accession No. AAQ52376 "Sequence 30 from U.S. Pat. No. 6,593,293" Aug. 17, 2003.

Cry9Aa2 GenBank Accession No. CAA41425 "crystal protein, partial [Bacillus thuringiensis]" Jul. 26, 2016.

Cry9Aa3 GenBank Accession No. GQ249293 "*Bacillus thuringiensis* strain SC5(D2) cry9Aa-like protein gene, complete cds" Dec. 31, 2012.

Cry9Aa4 GenBank Accession No. GQ249294 "*Bacillus thuringiensis* strain T03C001 cry9Aa-like protein gene, complete cds" Dec. 31, 2012.

Cry9Aa5 GenBank Accession No. JX174110 "*Bacillus* sp. enrichment culture clone BGSN1 Cry9Aa5 gene, complete cds" Jul. 13, 2013.

Cry9Aal GenBank Accession No. CAA41122 "delta-endotoxin CrylG protoxin [Bacillus thuringiensis serovar galleriae]" Apr. 18, 2005.

Cry9Ba2 GenBank Accession No. GU299522 "Bacillus thuringiensis insecticidal crystal protein Cry9Ba2 gene, complete cds" Dec. 1, 2010.

Cry9Bal GenBank Accession No. CAA52927 "delta-endotoxin, partial [Bacillus thuringiensis]" Jul. 26, 2016.

Cry9Bbl GenBank Accession No. AAV28716 "Cry9Bb delta-endotoxin [Bacillus thuringiensis serovar japonensis]" Jul. 7, 2008.

Cry9Ca2 GenBank Accession No. AAQ52375 "Sequence 28 from U.S. Pat. No. 6,593,293" Aug. 17, 2003.

Cry9Cal GenBank Accession No. CAA85764 "unnamed protein product [Bacillus thuringiensis]" Apr. 18, 2005.

Cry9Da2 GenBank Accession No. AAB97923 "delta-endotoxin, partial [Bacillus thuringiensis serovar japonensis]" Mar. 3, 2017.

Cry9Da4 GenBank Accession No. GQ249297 "*Bacillus thuringiensis* strain T03B001 cry9Eb-like protein gene, complete cds" Oct. 31, 2013.

Cry9Dal GenBank Accession No. BAA19948 "cry9Da1 [Bacillus thuringiensis serovar japonensis]" Feb. 6, 1999.

Cry9Dbl GenBank Accession No. AAX78439 "crystal protein Cry9Db1 [Bacillus thuringiensis]" Apr. 11, 2005.

Cry9Dcl GenBank Accession No. KC156683 "*Bacillus thuringiensis* strain ARP168 pesticidal protein gene, complete cds" Nov. 14, 2013.

Cry9Ea2 GenBank Accession No. AAO12908 "crystal endotoxin Cry9Ea [Bacillus thuringiensis]" Dec. 29, 2002.

(56)　　　　References Cited

OTHER PUBLICATIONS

Cry9Ea3 GenBank Accession No. ABM21765 "cry9Ea3 insecticidal crystal protein [Bacillus thuringiensis]" Jan. 17, 2007.
Cry9Ea4 GenBank Accession No. ACE88267 "pesticidal crystal protein [Bacillus thuringiensis]" Jun. 24, 2008.
Cry9Ea5 GenBank Accession No. ACF04743 "Cry9Ea protein (plasmid) [Bacillus thuringiensis]" Jul. 26, 2016.
Cry9Ea6 GenBank Accession No. ACG63872 "Cry9Ea [Bacillus thuringiensis]" Aug. 17, 2008.
Cry9Ea7 GenBank Accession No. FJ380927 "Bacillus thuringiensis strain Bt4 plasmid Cry9Ea (cry9Ea) gene, complete cds" Jul. 24, 2016.
Cry9Ea8 GenBank Accession No. GQ249292 "Bacillus thuringiensis strain SC5(E8) cry9Ea-like protein gene, complete cds" Dec. 31, 2012.
Cry9Ea9 GenBank Accession No. JN651495 "Bacillus thuringiensis strain LTS-7 Cry9Ea gene, complete cds" Feb. 5, 2015.
Cry9Eal GenBank Accession No. BAA34908 "Cry9 like protein [Bacillus thuringiensis serovar aizawai]" Feb. 5, 1999.
Cry9Eb2 GenBank Accession No. GQ249298 "Bacillus thuringiensis strain T23001 cry9Eb-like protein gene, complete cds" Oct. 31, 2013.
Cry9Eb3 GenBank Accession No. KC156646 "Bacillus thuringiensis strain ARP057 pesticidal protein gene, complete cds" Nov. 14, 2013.
Cry9Ebl GenBank Accession No. CAC50780 "unnamed protein product [Bacillus thuringiensis]" Aug. 8, 2001.
Cry9Edl GenBank Accession No. AAX78440 "crystal protein Cry9Ed1 [Bacillus thuringiensis]" Apr. 11, 2005.
Cry9Ee2 GenBank Accession No. KC156664 "Bacillus thuringiensis strain ARP095 pesticidal protein gene, complete cds" Nov. 14, 2013.
Cry9Eel GenBank Accession No. GQ249296 "Bacillus thuringiensis strain T03B001 cry9Ea-like protein gene, complete cds" Oct. 31, 2013.
Cry9Fal GenBank Accession No. KC156692 "Bacillus thuringiensis strain ARP212 pesticidal protein gene, complete cds" Nov. 14, 2013.
Cry9Gal GenBank Accession No. KC156699 "Bacillus thuringiensis strain ARP188 pesticidal protein gene, complete cds" Nov. 14, 2013.
Cry9-like GenBank Accession No. AAC63366 "delta-endotoxin [Bacillus thuringiensis]" Dec. 10, 2003.
Cryl 1Aa2 GenBank Accession No. AAA22611 "67 kd mosquitocidal protein, partial [Bacillus thuringiensis]" Apr. 26, 1993.
Cryl Fbl GenBank Accession No. CAA80235 "crystal protein [Bacillus thuringiensis]" Apr. 18, 2005.
Cryl 1Aal GenBank Accession No. AAA22352 "mosquito-toxic crystal protein [Bacillus thuringiensis]" Apr. 26, 1993.
Cryl6Aal GenBank Accession No. CAA63860 "cbm71 mosquitocidal toxin [[Clostridium] bifermentans]" Jun. 17, 1996.
Cryl8Bal GenBank Accession No. AAF89667 "parasporal crystal protein Cry18Ba1 [Paenibacillus popilliae]" Aug. 1, 2000.
CrylAa1 GenBank Accession No. AAA22353 "crystal protein [Bacillus thuringiensis]" Apr. 26, 1993.
CrylAa10 GenBank Accession No. AAD55382 "135 kDa insecticidal protein [Bacillus thuringiensis serovar kurstaki]" Sep. 16, 1999.
CrylAa11 GenBank Accession No. CAA70856 "delta-endotoxin [Bacillus thuringiensis serovar kurstaki]" May 13, 2010.
CrylAb11 GenBank Accession No. 112419 "Sequence 2 from U.S. Pat. No. 5,424,409" Jul. 26, 1995.
CrylAc10 GenBank Accession No. CAA05505 "insecticidal crystal protein [Bacillus thuringiensis serovar kurstaki str. YBT-1520]" Apr. 15, 2005.
CrylAc11 GenBank Accession No. CAA10270 "crystal toxin protein [Bacillus thuringiensis]" Apr. 15, 2005.
CrylAc17 GenBank Accession No. AAX18704 "Cry1Ac [Bacillus thuringiensis serovar kenyae]" Dec. 1, 2008.

CrylAd1 GenBank Accession No. AAA22340 "cry1A(d) [Bacillus thuringiensis serovar aizawai]" Apr. 26, 1993.
CrylAel GenBank Accession No. AAA22410 "delta-endotoxin [Bacillus thuringiensis serovar alesti]" Apr. 26, 1993.
CrylAf1 GenBank Accession No. AAB82749 "insecticidal crystal protein, partial (plasmid) [Bacillus thuringiensis]" Jul. 26, 2016.
CrylAg1 GenBank Accession No. AAD46137 "lepidoteran-specific toxin [Bacillus thuringiensis]" Aug. 1, 1999.
CrylAh1 GenBank Accession No. AAQ14326 "delta-endotoxin Cry1A [Bacillus thuringiensis]" Mar. 4, 2008.
CrylAi1 GenBank Accession No. AAO39719 "insecticidal crystal protein [Bacillus thuringiensis]" Aug. 30, 1996.
CrylBb1 GenBank Accession No. AAA22344 "crystal protein [Bacillus thuringiensis]" Apr. 25, 1994.
CrylBe1 GenBank Accession No. AAC32850 "Cry1Be1 delta-endotoxin (plasmid) [Bacillus thuringiensis]" Apr. 3, 2020.
CrylBf1 GenBank Accession No. CAC50778 "unnamed protein product [Bacillus thuringiensis]" Aug. 8, 2001.
CrylCa10 GenBank Accession No. AAN16462 "insecticidal protein Cry1C, partial [Bacillus thuringiensis]" Jul. 24, 2016.
CrylCb1 GenBank Accession No. M97880 "Bacillus thuringiensis cryIC-related gene sequence" Jun. 11, 1993.
CrylEa10 GenBank Accession No. ADR00398 "Cry1Ea10 [Bacillus thuringiensis]" May 27, 2011.
CrylEa11 GenBank Accession No. JQ652456 "Bacillus thuringiensis strain BRC-XQ12 insecticidal crystal protein Cry1Ea11 (cry1Ea11) gene, partial cds" Mar. 31, 2012.
CrylGal GenBank Accession No. CAA80233 "crystal protein [Bacillus thuringiensis]" Apr. 18, 2005.
CrylGbl GenBank Accession No. AAD10291 "insecticidal crystal protein CryH2 [Bacillus thuringiensis serovar wuhanensis]" Jan. 29, 1999.
CrylGcl GenBank Accession No. AAQ52381 "Sequence 40 from U.S. Pat. No. 6,593,293" Aug. 17, 2003.
CrylHa1 GenBank Accession No. CAA80236 "crystal protein [Bacillus thuringiensis]" Apr. 18, 2005.
CrylHbl GenBank Accession No. AAA79694 "crystal toxin [Bacillus thuringiensis]" Oct. 19, 1995.
CrylH-like GenBank Accession No. AAF01213 "endotoxin, partial [Bacillus thuringiensis]" Jul. 26, 2016.
Crylla11 GenBank Accession No. CAC85964 "delta-endotoxin [Bacillus thuringiensis serovar kurstaki]" Jul. 22, 2003.
Cryllal GenBank Accession No. CAA44633 "delta-endotoxin [Bacillus thuringiensis serovar kurstaki]" Apr. 18, 2005.
Cryllal7 GenBank Accession No. GU989199 "Bacillus thuringiensis strain BT-MX2 Cry1I toxin crystal protein gene, complete cds" Apr. 26, 2010.
Cryllal8 GenBank Accession No. ADK23801 "Cry1I toxin Crystal protein [Bacillus thuringiensis]" Jul. 18, 2010.
Cryllal9 GenBank Accession No. HQ439787 "Bacillus thuringiensis strain SC6H8 Cry1I-like protein gene, partial cds" Jul. 25, 2016.
Cryllb1 GenBank Accession No. AAA82114 "cryV465 [Bacillus thuringiensis]" Nov. 29, 1995.
Cryllbll GenBank Accession No. JQ228423 "Bacillus thuringiensis strain HD12 Cry1Ib (cry1Ib) gene, partial cds" Nov. 30, 2015.
Cryllcl GenBank Accession No. AAC62933 "crystal protein toxin (plasmid) [Bacillus thuringiensis]" Jul. 25, 2016.
Crylldl GenBank Accession No. AAD44366 "insecticidal crystal protein [Bacillus thuringiensis]" Jul. 20, 1999.
Cryllel GenBank Accession No. AAG43526 "Cry1I (plasmid) [Bacillus thuringiensis]" Jul. 14, 2016.
Cryllgl GenBank Accession No. KC156701 "Bacillus thuringiensis strain ARP166 pesticidal protein gene, complete cds" Nov. 14, 2013.
CrylI-like GenBank Accession No. AAC31094 "Sequence 10 from U.S. Pat. No. 5,723,758" Aug. 10, 1998.
CrylI-like GenBank Accession No. ABG88859 "Cry1I-like Bt toxin OL3, partial [Bacillus thuringiensis]" Jul. 14, 2016.
CrylJal GenBank Accession No. AAA22341 "crystal protein [Bacillus thuringiensis]" Apr. 26, 1994.
CrylJbl GenBank Accession No. AAA98959 "delta-endotoxin CryET1 [Bacillus thuringiensis]" Nov. 26, 2012.

(56) References Cited

OTHER PUBLICATIONS

CrylJcl GenBank Accession No. AAC31092 "Sequence 6 from U.S. Pat. No. 5,723,758" Aug. 10, 1998.

CrylJdl GenBank Accession No. CAC50779 "unnamed protein product [Bacillus thuringiensis]" Aug. 8, 2001.

CrylKal GenBank Accession No. AAB00376 "Cry1K [Bacillus thuringiensis]" May 20, 1996.

CryllAa-like GenBank Accession No. DQ166531 "*Bacillus thuringiensis* strain LDC-9 mosquito toxic crystal protein-like (cry11Aa) gene, partial sequence" Feb. 2, 2006.

CrylLal GenBank Accession No. AAS60191 "crystal protein [Bacillus thuringiensis serovar kurstaki]" Mar. 17, 2004.

CryllBal GenBank Accession No. CAA60504 "mosquitocidal toxin [Bacillus thuringiensis]" Mar. 20, 1996.

CryllBbl GenBank Accession No. AAC97162 "d-endotoxin [Bacillus thuringiensis serovar medellin]" Dec. 18, 1998.

Cryllfl GenBank Accession No. AAQ52382 "Sequence 42 from U.S. Pat. No. 6,593,293" Aug. 17, 2003.

Cryl-like GenBank Accession No. AAC31091 "Sequence 4 from U.S. Pat. No. 5,723,758" Aug. 10, 1998.

CrylMal GenBank Accession No. FJ884067 "*Bacillus thuringiensis* strain LBIT 1189 clone S1189-B Cry1-like delta-endotoxin gene, complete cds" Jul. 24, 2016.

CrylNal GenBank Accession No. KC156648 "*Bacillus thuringiensis* strain ARP009 pesticidal protein gene, complete cds" Nov. 14, 2013.

CrylNbl GenBank Accession No. KC156678 "*Bacillus thuringiensis* strain ARP146 pesticidal protein gene, complete cds" Nov. 14, 2013.

CrylOAal GenBank Accession No. AAA22614 "insecticidal endotoxin (put.); putative [Bacillus thuringiensis]" Apr. 26, 1993.

CryIOA-like GenBank Accession No. DQ167578 "*Bacillus thuringiensis* strain LDC-9 pesticidal crystal protein c10Aa-like (cry10Aa) gene, partial sequence" Feb. 6, 2006.

Curatti, et al., Genes required for rapid expression of nitrogenase activity in Azotobacter vinelandii. PNAS 2005; 102(18): 6291-6296.

Cyt1Aa GenBank Accession No. X03182 "Bacillus thuringiensis gene for crystal protein (Mr 28 000)" Oct. 23, 2008.

Cyt1Ab GenBank Accession No. X98793 "B.thuringiensis cyt1Ab1 gene" Apr. 18, 2005.

Cyt1B GenBank Accession No. U37196 "Bacillus thuringiensis delta endotoxin gene, complete cds" Jul. 11, 1996.

Cyt2A GenBank Accession No. Z14147 "B.thuringiensis gene for CytB toxin" Apr. 18, 2005.

Cyt2B GenBank Accession No. U52043 "Bacillus thuringiensis plasmid pRX80 CytB toxin homolog (cytB) gene, complete cds" Jul. 26, 2016.

Czar, et al. "Gene synthesis demystified." Trends in Biotechnology (Feb. 2009); 27(2): 63-72. Epub Dec. 26, 2008.

Da Silva, M. F., et al., "Survival of endophytic bacteria in polymer-based inoculants and efficiency of their application to sugarcane," Plant and Soil 356, pp. 231-243 (2012), https://doi.org/10.1007/s11104-012-1242-3.

Dandekar, T., Snel, B., Huynen, M., & Bork, P. Conservation of gene order: a fingerprint of proteins that physically interact. Trends Biochem. Sci. 23:324-328 (1998).

Das, H. K., et al, "Azotobacters as biofertilizer," Advances in Applied Microbiology 2019, vol. 108, pp. 1-43, doi: 10.1016/bs.aambs.2019.07.001.

Das, S. & De, T. K., "Microbial assay of N2 fixation rate, a simple alternate for acetylene reduction assay," MethodsX 5 (2018), p. 909-914, doi: 10.1016/j.mex.2017.11.010.

Dash, N., et al., "Functionalities of Phosphate-Solubilizing- Bacteria of Rice Rhizosphere: Techniques and Perspectives," Recent Advances in Applied Microbiology, 2017, 151-163, DOI 10.1007/978-981-10-5275-0_7.

Database WPI, 0, Derwent World Patents Index, vol. 1989, No. 42, Database accession No. 1989-304907 & JPH01225483 A 19890908 (Kyowa Hakko Kogyo KK), abstract, 2 pages.

Database WPI, 0, Derwent World Patents Index, vol. 2015, No. 20, Database accession No. 2015-165987, JP2015042633 A 2015/03/05 (Maekawa Seisakusho KK) [Y] 1-18, 8 pages.

Datsenko and Wanner, "One-step inactivation of chromosomal genes in *Escherichia coli* K-12 using PCR products". PNAS (Jun. 6, 2000); 97(12): 6640-6645.

Davin-Regli et al. "Enterobacter aerogenes and Enterobacter cloacae; versatile bacterial pathogens confronting antibiotic treatment," Front Microbiol, May 2015, vol. 6, 392:1-10.

De Freitas, J.R., "Yield and N assimilation of winter wheat (*Triticum aestivum* L., var. Norstar) inoculated with rhizobacteria", Pedobiologia 2000, vol. 44, pp. 97-104, doi:10.1078/S0031-4056(04)70031-1.

De Raad, M., et al. "A solid-phase platform for combinatorial and scarless multipart gene assembly". ACS Synth. Biol. 2:316-326 (2013).

De Werra, P., et al., "Role of Gluconic Acid Production in the Regulation of Biocontrol traits of Pseudomonas fluorescens CHA0," Applied and Environmental Microbiology, Jun. 2009, 75(12): 4162-4174, doi: 10.1128/AEM.00295-09.

Debruijn, F.J., et al., The Cloning and characterization of the glnF (ntrA) Gene of Klebsiella pneumoniae: Role of glnF (ntrA) in the Regulation of Nitrogen Fixation (nif) and other Nitrogen assimilation genes. Mol. Gen. Genet. 1983; 192:342-353.

Decision of Final Rejection, dated Jun. 1, 2023, for Japanese Patent Application No. 2021-135296 (8 total pages).

Decision of Refusal, dated Apr. 27, 2023, for Japanese Patent Application No. 2020- 524148 (12 total pages).

Decision of Rejection, dated Apr. 23, 2021, for Japanese Patent Application No. 2018- 536712 (8 total pages).

Decision on grant of patent for invention, dated Apr. 3, 2023, for Russian Patent Application No. 2019125282 (16 total pages).

Decision on grant of patent for invention, dated Feb. 8, 2022, for Russian Patent Application No. 2018105055 (15 total pages).

Decision on grant of patent for invention, dated Feb. 9, 2023, for Russian Patent Application No. 2020116780 (15 total pages).

Delaux, et al., Tracing the evolutionary path to nitrogen-fixing crops. Curr. Opin. Plant Biol. 2015; 26:95-99.

Dent, et al., Establishing symbiotic nitrogen fixation in cereals and other non-legume crops: The greener nitrogen revolution. Agric & Food Secur 2017; 6(7): 1-9.

Dersch, L. M., et al., "Novel Approach for High-Throughput Metabolic Screening of Whole Plants by Stable Isotopes," Plant Physiology, May 2016, vol. 171, No. 1, pp. 25-41, DOI: 10.1104/pp.15.01217.

Desnoues, N. et al., Nitrogen fixation genetics and regulation in a *Pseudomonas stutzeri* strain associated with rice. Microbiology, 2003; 149:2251-2262.

Dessaux, Y. et al., "Engineering the Rhizosphere", Trends Plant Science, Mar. 2016, vol. 21, No. 3, pp. 266-278. doi: 10.1016/j.tplants.2016.01.002.

Dixon et al. "Characterisation of the Klebsiella pneumoniae nitrogen-fixation regulatory proteins NIFA and NIFL in vitro". (1990) Eur. J. Biochem. 187: 353-360. (Year: 1990).

Dixon, R. et al. "Genetic regulation of biological nitrogen fixation," Nature Reviews Microbiology, Aug. 2004, vol. 2, pp. 621-631.

Dixon, R. et al. "Genetic transfer of nitrogen fixation from Klebsiella pneumoniae to *Escherichia coli*," Nature (1972), 237(5350):102-103.

Dong, et al. Kinetics and Strain Specificity of Rhizosphere and Endophytic Colonization by Enteric Bacteria on Seedlings of Medicago sativa and Medicago truncatula. Appl Environ Microbial. Mar. 2003; 69(3): 1783-1790.

Doroshchuk, N. A., "Regulation of Nitrogen Metabolism in Gram-Positive Bacteria," Molecular Biology 2006, vol. 40, No. 5, pp. 829-836.

Dos Santos, P. C. et al. "Distribution of nitrogen fixation and nitrogenase-like sequences amongst microbial genomes". BMC Genomics, 2012; (13)162: 1-12.

Drummond et al., "Expression from the nifB promoter of Azotobacter vinelandii can be activated by NifA, VnfA, or AnfA transcriptional activators", Journal of bacteriology, Feb. 1996, vol. 178, No. 3., pp. 788-792.

(56)　　　　　References Cited

OTHER PUBLICATIONS

Du et al., Customized optimization of metabolic pathways by combinatorial transcriptional engineering. Nucleic Acids Res. 2012;40(18):e142, 10 pages.

Duca Daiana et al: "Indole-3-acetic acid 15 in plant-microbe interactions", Antonie Van Leeuwenhoek, Springer, Dordrecht; NL., vol. 106, No. 1, Jan. 21, 2014 (Jan. 21, 2014), pp. 85-125, ISSN: 0003-6072, DOI: 10.1007/S10482-013-0095-Y [retrieved on Jan. 21, 2014].

Dunican, L. K. et al, "Genetic Transfer of Nitrogen Fixation from Rhizobium Trifolii to Klebsiella Aerogenes," Biochemical and Biophysical Research Communications, vol. 57, No. 1, pp. 62-72 (1974).

Dykxhoorn et al., (1996) A set of compatible tac promoter expression vectors. Gene 177(1-2):133-136.

Easter, et al., "Role of the parCBA Operon of the Broad-Host-Range Plasmid RK2 in Stable Plasmid Maintenance," Journal of Bacteriology, 1998, 180(22):6023-6030.

Eberhart et al., A methodology for markerless genetic modifications in Azotobacter vinelandii. Journal of Applied Microbiology (2016), 120: 1595-1604 (Year: 2016).

Egener, et al., Identification of NifL-like protein in a diazotroph of the b-subgroup of the proteobacteria, *azoarcus* sp. strain BH72, Microbiology 2002; 148: 3203-3212.

Emboss Needle: Pairwise Sequence Alignment. Retrieved on Oct. 31, 2023. Retrieved from https://www.ebi.ac.uk/Tools/psa/emboss_needle/, 2 pages.

Endy et al., "Foundations for engineering biology," Nature, 2005, 438:449-453.

Engler, Carola, et al., "A One Pot, One Step, Precision Cloning Method with High Throughput Capability." Plos One (Nov. 2008); 3.11: e3647, pp. 1-7. Epub Nov. 5, 2008.

Engler, et al., "Golden Gate Shuffling: A One-Pot DNA Shuffling Method Based on Type IIs Restriction Enzymes". PLoS One (2009); 4(5): e5553, 9 pages. Epub May 14, 2009.

Enkh-Amgalan, et al., "Molecular evolution of the nif gene cluster carrying nifI1 and nifI2 genes in the Gram-positive phototrophic bacterium Heliobacterium chlorum," International Journal of Systematic and Evolutionary Microbiology, 2006, 56:65-74.

EP Extended European Search Report in European Application No. 16854192.8, dated Feb. 20, 2019, 11 pages.

Espin, G., et al., "Complementation Analysis of glnA-Linked Mutations which Affect Nitrogen Fixation in Klebsiella pneumoniae," Mol. Gen. Genet. 1981, vol. 184, pp. 213-217.

Estrem, et al., "Identification of an UP element consensus sequence for bacterial promoters," PNAS, 95 (11): 9761-9766 (1998).

Examination Report, dated Aug. 17, 2022, for Canadian Patent Application No. 2,991,776 (5 total pages).

Examination Report, dated Aug. 22, 2022, for Russian Patent Application No. 2019125282 (15 total pages).

Examination Report, dated Dec. 12, 2022, for Canadian Patent Application No. 3,001,001 (7 total pages).

Examination Report, dated Dec. 16, 2020, for Indian Patent Application No. 201817001025 (7 total pages).

Examination Report, dated Feb. 15, 2023, for Australian Application No. 2018207204, 2 pages.

Examination Report, dated Feb. 24, 2022, for Argentina Patent Application No. 20180100082 (7 total pages).

Examination Report, dated Feb. 8, 2023, for Brazilian Patent Application No. BR122022025322-9 (26 total pages.

Examination Report, dated Feb. 8, 2023, for Brazilian Patent Application No. BR112018006800-4, 26 total pages.

Examination Report, dated Jan. 31, 2022, for Philippines Patent Application No. Jan. 2018/500103 (5 total pages).

Examination Report, dated Jan. 5, 2023, for Canadian Patent Application No. 2,991,776 (6 total pages).

Examination Report, dated Jul. 17, 2023, for Canadian Patent Application No. 3,104,531 (6 total pages).

Examination Report, dated Jun. 13, 2023, for Canadian Patent Application No. 2,991,776 (5 total pages).

Examination Report, dated Jun. 14, 2022, for Brazilian Patent Application No. BR112019014378-5 (8 total pages).

Examination Report, dated Jun. 17, 2022, for Indian Patent Application No. 201817011738 (7 total pages).

Examination Report, dated Jun. 26, 2023, for Brazilian Application No. 112018006800-4, 12 pages.

Examination Report, dated Jun. 27, 2023, for Brazilian Application No. 122022025322-9, 9 pages.

Examination Report, dated Jun. 28, 2022, for Brazilian Patent Application No. BR122020010314-0, 9 pages.

Examination Report, dated Jun. 29, 2023, for Canadian Patent Application No. 3,049,258 (7 total pages).

Examination Report, dated Jun. 30, 2023, for Canadian Patent Application No. 3,129,539 (5 total pages).

Examination Report, dated Jun. 8, 2021, for Bangladesh Application No. 113/2020 (1 total page).

Examination Report, dated Mar. 6, 2023, for Australian Application No. 2022271476 (5 total pages).

Examination Report, dated May 10, 2022, for Brazilian Patent Application No. BR112018000729-3 (7 total pages).

Examination Report, dated May 20, 2021, for Philippines Patent Application No. 1/2018/500103 (4 total pages).

Examination Report, dated May 24, 2023, for Canadian Patent Application No. 3,137,739 (4 total pages).

Examination Report, dated May 31, 2022, for Brazilian Patent Application No. BR112020008002-0 (7 total pages).

Examination Report, dated May 9, 2023, for Canadian Patent Application No. 3,079,955 (5 total pages).

Examination Report, dated Nov. 18, 2021, for Australian Patent Application No. 2016336328, 5 pages.

Examination Report, dated Nov. 25, 2022, for Brazilian Patent Application No. BR122020010314-0 (7 total pages).

Examination Report, dated Nov. 6, 2023, for Canadian Patent Application No. 2,991,776 (5 total pages).

Examination Report, dated Oct. 20, 2023, for Brazilian Patent Application No. BR122020010314-0 (20 total pages).

Examination Report, dated Oct. 23, 2023, for Brazilian Application No. BR112018006800-4 (14 total pages).

Examination Report, dated Oct. 23, 2023, for Brazilian Application No. BR122022025322-9 (14 total pages).

Examination Report, dated Sep. 13, 2023, for Canadian Patent Application No. 3,159,678 (5 total pages).

Examination Report, dated Sep. 21, 2023, for Australian Application No. 2018354338, 2 pages.

Examination Report dated Sep. 7, 2022, for Australian Application No. 2016336328, 6 pages.

Examination Report, received Apr. 14, 2021, for Pakistan Patent Application No. 264/2020 (1 total page).

Examination Report with Search Report, dated Jul. 27, 2023, for Russian Patent Application No. 2023103521 (25 total pages).

Examination Report with Search Report, dated Mar. 27, 2023, for Russian Patent Application No. 2021101586, 18 pages.

Examination Report, with Search Report dated Mar. 3, 2020, for Brazilian Patent Application No. 112018006800-4 (7 total pages).

Examination Report with Search Report, dated May 31, 2022, for Russian Patent Application No. 2020116780 (15 total pages).

Examination Report with Search Report, dated Oct. 17, 2023, for Russian Patent Application No. 2021134059 (22 total pages).

Extended European Search Report and Search Opinion, dated Feb. 1, 2021, for European Patent Application No. 18739050.5 (20 total pages).

Extended European Search Report and Search Opinion, dated May 22, 2023, for European Patent Application No. 20795673.1 (9 total pages).

Extended European Search Report, dated Mar. 14, 2022, for European Application No. 19833252.0 (6 total pages).

Extended European Search Report for EP16825147.8, dated Jun. 6, 2019, 19 pages.

Extended European Search Report for European Application No. 12800054.4, mailed Dec. 19, 2014, 8 Pages.

Extended European Search Report for European Application No. 19186353.9, mailed Nov. 13, 2019, 9 Pages.

(56) References Cited

OTHER PUBLICATIONS

Extended European Search Report for European Application No. 19826654.6, mailed Jul. 4, 2022, 16 Pages.

Extended European Search Report in European Application No. 18870036.3, dated Dec. 14, 2021, 26 pages.

Extended Search Report and Search Opinion, dated Jul. 22, 2021, for European Patent Application No. 18843845.1 (18 total pages).

Extended Search Report and Search Opinion, dated Jul. 22, 2021, for European Patent Application No. 18870346.6 (5 total pages).

Eyraud, V., et al.; "Expression and biological activity of the cystine knot bioinsecticide PA1b (Pea Albumin 1 Subunit b)," PLoS One; 8(12): e81619; 9 pages (2013); doi: 10.1371/journal.pone.0081619.

Fani et al., "Molecular evolution of nitrogen fixation: the evolutionary history of the nilD, nifK, nifE, and nifN gene," J Mo/ Evol., 2000, 51(1): 1-11.

Feher, et al. In the fast lane: large-scale bacterial genome engineering. J Biotechnol. Jul. 31, 2012 ;160(1-2):72-9.

Fernandes, G. et al., Glutamine synthetase stabilizes the binding of GlnR to nitrogen fixation gene operators, The FEBS Journal 2017, vol. 284, No. 6, pp. 903-918.

Ferrieres, et al., "The yjbEFGH locus in *Escherichia coli* K-12 is an operon encoding proteins involved in exopolysaccharide production," Microbiology, Apr. 2007, 153(4):1070-80.

Final Office Action, dated Apr. 11, 2024, for U.S. Appl. No. 17/027,030, 35 pages.

Final Office Action, dated Dec. 7, 2023, for U.S. Appl. No. 17/255,304 (13 total pages).

Final Office Action, dated Feb. 2, 2021, for U.S. Appl. No. 15/766,122 (19 total pages).

Final Office Action, dated Jul. 21, 2020, for U.S. Appl. No. 16/192,738 (7 total pages).

Final Office Action, dated Mar. 26, 2024, for U.S. Appl. No. 17/278,022, 39 pages.

Fischbach, et al., The evolution of gene collectives: how natural selection drives chemical innovation. Proc. Natl. Acad. Sci. USA 105:4601-4608 (2008).

Fisher, et al., "Mutations in the Bacillus subtilis glnRA operon that cause nitrogen source-dependent defects in regulation of TnrA activity", Journal of bacteriology, Aug. 15, 2002, vol. 184, No. 16, pp. 4636-4639.

Fisher, et al., "Novel trans-acting Bacillus subtilis glnA mutations that derepress glnRA expression", Journal of bacteriology, Apr. 15, 2009, vol. 191, No. 8, pp. 2485-2492.

Flores-Núñez, V. M., et al., "Functional Signatures of the Epiphytic Prokaryotic Microbiome of Agaves and Cacti," Frontiers in Microbiology, Jan. 2020, vol. 10, Art. 3044, 13 pages, doi: 10.3389/fmicb.2019.03044.

Fontana, W., et al., RNA folding and combinatory landscapes. Phys. Rev. E. 47:2083-2099 (1993).

Forner, A., et al., "Treatment of hepatocellular carcinoma," Critical Reviews in Oncology/Hematology 60, Nov. 2006, pp. 89-98, doi:10.1016/j.critrevonc.2006.06.001.

Fox, et al., Major cereal crops benefit from biological nitrogen fixation when inoculated with the nitrogen-fixing bacterium Pseudomonas protegens Pf-5 X940. Environmental Microbiology 2016; 18(10):3522-3534.

Frasch et al., Design-based re-engineering of biosynthetic gene clusters: plug-and-play in practice. Curr Opin Biotechnol. Dec. 2013;24(6):1144-50, . doi: 10.1016/j.copbio.2013.03.006. Epub Mar. 27, 2013.

Gaby, et al. "A comprehensive aligned nifH gene database: a multipurpose tool for studies of nitrogen-fixing bacteria." Database (Oxford). Feb. 5, 2014;2014:bau001, 8 pages, doi: 10.1093/database/bau001.

Gamer, et al. A T7 RNA polymerase-dependent gene expression system for Bacillus megaterium. Appl Micro biol Biotechnol. Apr. 2009; 82(6):1195-203.

Gao, Y., et al., "Groundwater Nitrogen Pollution and Assessment of Its Health Risks: A Case Sutdy of a Typical Village in Rural-Urban Continuum, China," PLoS One, Apr. 2012, vol. 7, Issue 4, e33982, 8 pages.

Gebeyehu, G. et al., 1987, Novel biotinylated nucleotide-analogs for labeling and colorimetric detection of DNA, Nucl Acids Res., 15(11):4513-4534.

Geddes, B.A., Use of plant colonizing bacteria as chassis for transfer of N2-fixation to cereals. Curr. Opin. Biotechnol. 2015; 32:216-222.

GenBank: CP007215.3. Kosakonia sacchari SP1 chromosome, complete genome. Sep. 19, 2017, 805 pages.

"Genbank", Database accession No. X 13303.1. Apr. 18, 2005. 17 pages.

GenBank submission CP016337, Jul. 11, 2016 [online]. Retrieved on Feb. 21, 2022. Retrieved from the internet https://https://www.ncbi.nlm.nih.gov/protein/1043189580, 3 pages.

Georg, J. et al. "cis-Antisense RNA, another level of gene regulation in bacteria". Microbiol Mol Biol Rev. (2011). 75(2):286-300.

Gibson, A. H., "Physical Environment and Symbiotic Nitrogen Fixation," Australian Journal of Biological Sciences. 1963; 16, 28-42.

Gibson, et al., Chemical synthesis of the mouse mitochondrial genome. Nat. Methods 7, 901-903 (2010).

Gibson, et al., "Enzymatic assembly of DNA molecules up to several hundred kilobases." Nature Methods (Apr. 12, 2009); 6(5): 343-345.

Giri, K., et al., "The First Report of Indigenous Free-Living Diazotroph Kosakonia sacchari Isolated from Himalayan Alder-Based Shifting Cultivation System in Nagaland, India," Journal of Soil Science and Plant Nutrition (2019), 19:574-579, https://doi.org/10.1007/s42729-019-00056-5.

Global Agricultural Inoculants Market Research Report—Industry Analysis, Size, Share, Growth, Trends and Forecast 2015-2022, ReportBuyer, PreNewsWire.com, Dec. 8, 2016, 4 pages.

Gosink, M. M., et al., "The product of the Klebsiella pneumoniae nifX gene is a negative regulator of the nitrogen fixation (nif) regulon," J. Bacteriology, 1990, 172(3):1441-1447.

Gossen and Bujard, "Tight control of gene expression in mammalian cells by tetracycline-responsive promoters". Proc Natl Acad Sci U S A, Jun. 15, 1992; 89(12): 5547-5551.

Gossen, M. et al. (Jun. 2, 19953) "Transcriptional activation by tetracyclkines in mammalian cells" Science, 268(5218):1766-1769.

Gottelt et al., (2010) Deletion of a regulatory gene within the cpk gene cluster reveals novel antibacterial activity in Streptomyces coelicolor A3(2). Microbiology 156:2343-2353.

Govantes, et al. Mechanism of coordinated synthesis of the antagonistic regulatory proteins NifL and NifA of Klebsiella pneumoniae. J Bacteriol. Dec. 1996; 178(23): 6817-6823.

Gruber, et al., "Versatile plasmid-based expression systems for Gram-negative bacteria—General essentials exemplified with the bacterium Ralstonia eutropha H16," New Biotechnology, Dec. 2015, vol. 32, No. 6, 552-558.

Gruber, T. M. et al. "Multiple Sigma Subunits and the Partitioning of Bacterial Transcription Space". Annu. Rev. Microbiol., (2003), vol. 57, pp. 441-466.

Gu, C. T., et al., "*Enterobacter xiangfangensis* sp. nov., isolated from Chinese traditional sourdough, and reclassification of Enterobacter sacchari Zhu et al. 2013 as Kosakonia sacchari comb. nov.," International Journal of Systematic and Evolutionary Microbiology (2014), 64, 2650-2656, DOI: 10.1099/ijs.0.064709-0.

Guell et al., "Bacterial transcriptomics: what is beyond the RNA horiz-ome?" Nature reviews. Microbiology. (2011). 9(9):658-669.

Guell, et al. "Transcriptome complexity in a genome-reduced bacterium". Science. (2009). 326:1268-1271.

Guo et al., Discovery of Reactive Microbiota-Derived Metabolites that Inhibit Host Proteases. Cell. Jan. 26, 2017;168(3):517-526.e18.

Haapalainen, et al., Soluble plant cell signals induce the expression of the type ILL secretion system of Pseudomonas syringae and upregulate the production of pilus protein HrpA. Mol. Plant Microbe Interact. 22, 282-290 (2009).

Hale, et al., An efficient stress-free strategy to displace stable bacterial plasmids. Bio Techniques 2010; 48:223-228.

(56)　　　　　References Cited

OTHER PUBLICATIONS

Hansal, et al. Cutting Edge: Induction of antigen-specific hyporesponsiveness by transplantation of hemopoietic cells containing an MHC class I transgene regulated by a lymphocyte-specific promoter. J Immunol. Aug. 1, 1998 ;161(3):1063-8.

Hara, S., et al., "Identification of Nitrogen-Fixing Bradyrhizobium Associated with Roots of Field-Grown Sorghum by Metagenome and Proteome Analyses," Frontiers in Microbiology, Mar. 2019, vol. 10, Art. 407, pp. 1-15, DOI: 10.3389/fmicb.2019.00407.

Hardarson, G., et al., "Use of 15N methodology to assess biological nitrogen fixation," Use of nuclear techniques in studies of soil-plant relationships, International Atomic Energy Agency, Vienna 1990, pp. 129-160.

Harvey et al., Inducible control of gene expression: prospects for gene therapy, Curr. Opin. Chem. Biol., 2:512-518 (1998).

Hearing Notice, dated Dec. 1, 2023, for Indian Patent Application No. 201817001025, 4 pages.

Hearing Notice, dated Dec. 26, 2023, for Indian Patent Application No. 201817001025, 4 pages.

Hearing Notice, dated Feb. 14, 2023, for Indian Patent Application No. 201817011738 (2 total pages).

Hearing Notice, dated Jan. 8, 2024, for Indian Patent Application No. 201917031229. 3 pages.

Henikoff et al., "Amino acid substitution matrices from protein blocks," Proc. Natl. Acad. Sci. U.S.A., Nov. 1992, 89: 10915-10919.

Herlache, et al. Characterization of the Agrobacterium vitis pehA gene and comparison of the encoded polygalacturonase with the homologous enzymes from Erwinia carotovora and Ralstonia solanacearum. Appl Environ Microbial. Jan. 1997; 63(1): 338-346.

Hernandez, J.A., et al. "Biochemical analysis of the recombinant Fur (ferric uptake regulator) protein from Anabaena PCC 7119: factors affecting its oligomerization state," Biochem J., 2002, 366:315-322.

Hesketh, A. et al., "The GlnD and GlnK homologues of Streptomyces coelicolor A3(2) are functionally dissimilar to their nitrogen regulatory system counterparts from enteric bacteria," Molecular Microbiology (2002) (2), 319-330.

Hett,, E. C., et al., "Bacterial Growth and Cell Division: a Mycobacterial Perspective," Microbiology and Molecular Biology Reviews, vol. 72, Issue 1, Mar. 2008, pp. 126-156, https://doi.org/10.1128/MMBR.00028-07 (61 total pages).

Hidaka, M. et al., "Promotion of the Growth of Rice by Inoculation of Nitrogen-Fixing-Activity-Enhanced Bacteria to the Rhizosphere," Nitrogen Fixation: From Molecules to Crop Productivity, Current Plant Science and Biotechnology in Agriculture, vol. 38, p. 445 (2002).

Higdon, S. M., et al., "Genomic characterization of a diazotrophic microbiota associated with maize aerial root mucilage," PLoS ONE, 15(9): e0239677, Sep. 2020, 26 pages, https://doi.org/10.1371/journal.pone.0239677.

Hoeschle-Zeledon, I., et al.; "Regulatory challenges for biological control," The CGIAR Systemwide Program on Integrated Pest Management, Jan. 2013; SP-IPM Secretariat, International Institute of Tropical Agriculture (IITA), Ibadan, Nigeria; 53 pages.

Holden, et al. Colonization outwith the colon: plants as an alternative environmental reservoir for human pathogenic enterobacteria. FEMS Microbiol. Rev. 33, 689-703 (2009).

Hosseini-Abari, A., et al., "LC/MS detection of oligogalacturonic acids obtained from tragacanth degradation by pectinase producing bacteria," Journal of Basic Microbiology, 2019, 59:249-255, DOI: 10.1002/jobm.201800332.

Hu et al., (2008) Assembly of nitrogenase MoFe protein. Biochemistry 47(13):3973-3981.

Hu, L., et al., "Application of bryophyte rhizoid-associated bacteria increases silicon accumulation and growth in maize (Zea mays L.) seedlings," App. Ecol. Env. Res., 2019, 17(6):13423-13433, DOI: http://dx.doi.org/10.15666/aeer/1706_1342313433.

Hunter, P., "Genetically Modified Lite" placates public but not activists. EMBO Reports 2014; 15(2): 138-141.

Huynen, et al., Smoothness within ruggedness: the role of neutrality in adaptation. Proc. Natl. Acad. Sci. USA 93:397-401 (1996).

Iber, D. A quantitative study of the benefits of co-regulation using the spollA operon as an example. Mol. Sys. Biol. 2, 1-6 (2006).

Idalia, V. N. et al., "Escherichia coli as a model organism and its application in biotechnology," Recent Advances on Physiology, Pathogenesis, and Biotechnological Applications, Chapter 13, 2017, pp. 253-274.

Iltis H. H., et al., "Zea diploperennis (Gramineae): A New Teosinte from Mexico" Science, vol. 203, Jan. 12, 1979, pp. 186-188.

Iniguez, A. L., et al., "Regulation of Enteric Endophytic Bacterial Colonization by Plant Defenses," MPMI (2005), vol. 18, No. 2, pp. 169-178, DOI: 10.1094/MPMI-18-0169.

Iniguez, et al., Nitrogen Fixation in Wheat Provided by Klebsiella pneumoniae 342. MPMI vol. 17, No. 10, 2004, pp. 1078-1085.

International Preliminary Report on Patentability dated Apr. 19, 2018 for International Application No. PCT/US2016/055429, 12 pages.

International Preliminary Report on Patentability dated Jul. 16, 2019 for International Application No. PCT/US2018/013671, 6 pages.

International Preliminary Report on Patentability dated May 14, 2015 for International Application No. PCT/US2013/068055, 11 pages.

International Preliminary Report on Patentability, dated Nov. 10, 2022, for International Application No. PCT/US2020/031199 (15 total pages).

International Preliminary Report on Patentability for International Application No. PCT/US2012/042502, mailed Jan. 3, 2014, 9 Pages.

International Preliminary Report on Patentability for International Application No. PCT/US2019/039528, mailed Jan. 7, 2021, 15 Pages.

International Preliminary Report on Patentability in International Application No. PCT/US2021/029895, dated Nov. 10, 2022 (14 total pages).

International Preliminary Report on Patentability in International Application No. PCT/US2021/031808, dated Nov. 24, 2022 (17 total pages).

International Preliminary Report on Patentability in International Appln. No. PCT/US2016/042170, dated Jan. 16, 2018, 19 pages.

International Preliminary Report on Patentability in International Appln. No. PCT/US2018/046148, dated Feb. 11, 2020, 12 pages.

International Preliminary Report on Patentability in International Appln. No. PCT/US2018/057174, dated Apr. 28, 2020, 5 pages.

International Preliminary Report on Patentability in International Appln. No. PCT/US2018/057613, dated Apr. 28, 2020, 8 pages.

International Preliminary Report on Patentability, mailed Apr. 1, 2021, for International Application No. PCT/US2019/052003 (10 total pages).

International Preliminary Report on Patentability, mailed Jul. 1, 2021, for International Application No. PCT/US2019/068152 (12 pages).

International Preliminary Report on Patentability, mailed Jul. 6, 2023, for International Application No. PCT/US2021/065051 (19 total pages).

International Preliminary Report on Patentability, mailed Nov. 10, 2022, for International Application No. PCT/US2020/031201 (17 total pages).

International Preliminary Report on Patentability, mailed Nov. 4, 2021, for International Application No. PCT/US2020/029831 (8 pages).

International Preliminary Report on Patentability, mailed, Nov. 4, 2021, for International Application No. PCT/US2020/029894, 13 pages.

International Search Report and Written Opinion dated Mar. 22, 2018, for International Application No. PCT/US2018/013671, 8 pages.

International Search Report and Written Opinion for International Application No. PCT/US2012/042502, mailed Jan. 31, 2013, 11 Pages.

(56) References Cited

OTHER PUBLICATIONS

International Search Report and Written Opinion for International Application No. PCT/US2013/068055, mailed Feb. 18, 2014, 16 Pages.

International Search Report and Written Opinion for International Application No. PCT/US2019/039528, mailed Nov. 6, 2019, 20 Pages.

International Search Report and Written Opinion for International Application No. PCT/US2020/029831, mailed Nov. 16, 2020, 12 pages.

International Search Report and Written Opinion for International Application No. PCT/US2021/055858 dated Mar. 25, 2022, 16 pages.

International Search Report and Written Opinion for PCT/US2020/014083, mailed on Jul. 20, 2020, 20 pages.

International Search Report and Written Opinion in International Appln. No. PCT/US2016/042170, dated Dec. 2, 2016, 26 pages.

International Search Report and Written Opinion in International Appln. No. PCT/US2016/055429, dated Dec. 30, 2016, 16 pages.

International Search Report and Written Opinion in International Appln. No. PCT/US2018/046148, dated Dec. 3, 2018, 6 pages.

International Search Report and Written Opinion in International Appln. No. PCT/US2018/057613, dated Mar. 5, 2019, 11 pages.

International Search Report and Written Opinion in International Appln. No. PCT/US2019/068152, dated Jun. 25, 2020, 21 pages.

International Search Report and Written Opinion in International Appln. No. PCT/US2020/031201, dated Mar. 18, 2021, 23 pages.

International Search Report and Written Opinion in PCT International Application No. PCT/US2019/052003, Jan. 9, 2020, 15 pages.

International Search Report and Written Opinion in PCT International Application No. PCT/US2020/029894, mailed Aug. 31, 2020, 18 pages.

International Search Report and Written Opinion mailed Apr. 16, 2020 for International Application No. PCT/US2019/064782, 13 pages.

International Search Report and Written Opinion, mailed Apr. 22, 2021, for PCT Application No. PCT/US2020/031199 (25 total pages).

International Search Report and Written Opinion, mailed Dec. 21, 2022, for International Application No. PCT/US2022/035873 (27 total pages).

International Search Report and Written Opinion, mailed Dec. 3, 2019, for International Application No. PCT/US2019/041429 (19 total pages).

International Search Report and Written Opinion, mailed Mar. 10, 2020, for International Appl. No. PCT/US2019/059450, 20 pages.

International Search Report and Written Opinion mailed Mar. 9, 2022 for International Application No. PCT/US2021/031808 (24 total pages).

International Search Report and Written Opinion, mailed May 15, 2023, for International Application No. PCT/US2023/011735 (22 total pages).

International Search Report and Written Opinion, mailed Nov. 19, 2019, for International Application No. PCT/US2019/039217, 13 pages.

International Search Report and Written Opinion, mailed Sep. 15, 2021, for International Application No. PCT/US2021/029993, 11 pages.

International Search Report and Written Opinion, mailed Sep. 24, 2021, for International Application No. PCT/US2021/029895 (20 total pages).

Invitation to Pay Additional Fees and, Where Applicable, Protest Fee, dated Jan. 27, 2021, for International Application No. PCT/US2020/031201 (11 total pages).

Invitation to Pay Additional Fees and, Where Applicable, Protest Fee, dated May 28, 2020, for International Application No. PCT/US2020/014083 (16 total pages).

Invitation to Pay Additional Fees, and Where Applicable, Protest Fee, dated Sep. 26, 2016, for International Application No. PCT/US2016/042170 (2 total pages).

Invitation to Pay Additional Fees, and Where Applicable, Protest Fee, dated Sep. 4, 2019, for International Application No. PCT/US2019/039528 (3 total pages).

Invitation to Pay Additional Fees and, Where Applicable, Protest Fee, dated Sep. 9, 2020, for International Application No. PCT/US2020/029831 (4 total pages).

Ishihama A, "Prokaryotic genome regulation: multifactor promoters, multitarget regulators and hierarchic networks", FEMS Microbiol Rev, (2010), vol. 34, No. 5, pp. 628-645.

Ivanova et al. "Artificial Regulation of Genes, of the coding proteins of the nitrogenase complex Rhizobial bacteria," Natural Sciences, 2014, 13(174):36-39 (English Machine Translation).

Izquierdo et al., "Distribution of Extensive nifH Gene Diversity Across Physical Soil Microenvironments," Microbial Ecology, 2006, 51(4):441-452.

Jacob et al., (1987) Solid-state NMR studies of Klebsiella pneumoniae grown under nitrogen-fixing conditions. J Biol Chem 262(1):254-259.

Jacoby et al., "The Role of Soil Microorganisms in Plant Mineral Nutrition-Current Knowledge and Future Directions," Frontiers in Plant Science, 2017, 8(19):1-19.

Jahn, A. & Nielsen, P. H., "Extraction of Extracellular Polymeric Substances (EPS) from Biofilms Using a Cation Exchange Resin," Wat. Sci. Tech., 32(8):157-164 (1995).

Janczarek, M., et al., "Multiple copies of rosR and pssA genes enhance exopolysaccharide production, symbiotic competitveness and clover nodulation in Rhizobium leguminosarum bv. trifolii," Antonie Van Leeuwenhoek (2009), vol. 96, pp. 471-486, published online Jul. 9, 2009, DOI: 10.1007/S10482-009-9362-3.

Jan-Philip Schluter et al: "Global mapping of transcription start sites and promoter motifs in the symbiotic [alpha]-proteobacterium Sinorhizobium meliloti", BMC Genomics, Biomed Central Ltd, London, UK, vol. 14, No. 1, Mar. 7, 2013 (Mar. 7, 2013), p. 156, ISSN: 1471-2164, DOI: 10.1186/1471-2164-14-156.

Jaschke, et al. A fully decompressed synthetic bacteriophage 0X174 genome assembled and archived in yeast. Virology 434, 278-284 (2012).

Jayaraman, R., et al., "Strain Improvement of Phosphate Solubilizing Fungal Strains," Journal of Ecobiotechnology, 2010, 2(5):65-70.

Jensen, K.F. The *Escherichia coli* K-12 "wild types" W3110 and MG1655 have an rph frameshift mutation that leads to pyrimidine starvation due to low pyrE expression levels. J. Bacteriol. 175:3401-3407 (1993).

Johnson, Z. I. et al. "Properties of overlapping genes are conserved across microbial genomes". Genome Res. (2004). 14(11):2268-2272.

Joseph R.C., et al., "Recent Development of the Synthetic Biology Toolkit for Clostridium", Frontiers in Microbiology, vol. 9, pp. 1-13, 2018.

Kabaluk, J. Todd, et al., ed. 2010, The use and regulation of microbial pesticides in representative jurisdictions worldwide. International Organization for Biological Control of Noxious Animals and Plants (IOBC), 99 pp. (108 total pages).

Kalir S, et al. (2001) Ordering genes in a flagella pathway by analysis of expression kinetics from living bacteria. Science 292(5524):2080-2083.

Kaneko, T., et al. Complete genomic structure of the cultivated rice endophyte *Azospirillum* sp. B510. DNA Res. 17:37-50 (2010).

Kant, et al. "Understanding plant response to nitrogen limitation for the improvement of crop nitrogen use efficiency." J Exp Bot. Feb. 2011;62(4):1499-509. doi: 10.1093/jxb/erq297.

Karlin et al. "Applications and statistics for multiple high-scoring segments in molecular sequences" Proceedings of the National Academy of Sciences (1993); 90(12):5873-5877.

Karlin, S., et al.; "Methods for assessing the statistical significance of molecular sequence features by using general scoring schemes," PNAS USA; 87(6):2264-2268 (1990).

Katsnelson, A., et al., "Engineered bacteria could boost com yields: Gene-edited microbe offer continuous nitrogen fixation," Chemical

(56) References Cited

OTHER PUBLICATIONS

& Engineering News, Dec. 28, 2021, retrieved from https://cen.acs.org/food/agriculture/Engineered-bacteria-boost-corn-yields/99/web/2021/12, 2 pages.

Kececiglu, J., et al., "Of mice and men: Algorithms for evolutionary distances between genomes with translocation," SODA: Proceedings of the sixth annual ACM-SIA symposium on Discrete algorithms, 1995, 10 pages.

Kelly, J.R., et al. "Measuring the activity of BioBrick promoters using an in vivo reference standard". J Biol Eng. (2009). 3:4. 13 pages.

Kent et al., "A Transposable Partitioning Locus Used to Stabilize Plasmid-Borne Hydrogen Oxidation and Trifolitoxin Production Genes in a *Sinorhizobium* Strain," Appl. Environ. Microbiol., 1998, 64(5):1657-1662.

Kerby, et al. Photoproduction of ammonium by immobilized mutant strains of *Anabaena variabilis*. Applied Microbiology and Biotechnology. Apr. 1986, vol. 24, Issue 1, pp. 42-46.

KFLGG, Nitrogen Metabolism—Pseudomonas fluorescences Pf0-1, https://www.genome.jp/kegg-bin/show_pathway?pfo00910 (Year: 2024).

Khandeparker, R. D. S., et al., "Extracellular polymeric substances of the marine fouling diatom amphora rostrata Wm.Sm," Biofouling (2001), 17(2):117-127, DOI: 10.1080/08927010109378471.

Kim, Y., et al., "A 20 nucleotide upstream element is essentail for the nopaline synthase (nos) promoter activity," Plant Molecular Biology 24: 105-117 (1994).

Kim, Y. et al., "Constitutive expression of nitrogenase system in Klebsiella oxytoca by gene targeting mutation to the chromosomal nifLA operon," Journal of Biotechnology, 10(3-4):293-301 (1989).

King, et al. "Spider-venom peptides: structure, pharmacology, and potential for control of insect pests." Annu Rev Entomol. 2013;58:475-96. doi: 10.1146/ammrev-ento-120811-153650.

Kingsford et al., "Rapid, accurate, computational discovery of Rho-independent transcription terminators illuminates their relationship to DNA uptake," Genome Bio. 2007, 8(2):R22, 12 pages.

Kitano, H. "Systems biology: a brief overview". Science. (2002). 295(5560): 1662-1664.

Klose, K., et al., "Glutamate at the Site of Phosphorylation of Nitrogen-regulatory Protein NTRC Mimics Aspartyl-Phosphate and Activates the Protein," Journal of Molecular Biology (1993), vol. 232, pp. 67-78.

Knight, T., "Idempotent Vector Design for Standard Assembly of Biobricks," MIT Artificial Intelligence Laboratory, the TTL Data Book for Design Engineers, 2003, 11 pages.

Knight, T.K. et al. "Cellular Gate Technology". Unconventional Models of Computation. (1997). pp. 257-272.

Kou, W., et al., "Identification of bacterial communities in sediments of Poyang Lake, the largest freshwater lake in China," SpringerPlus (2016), 5:401, pp. 1-9, DOI 10.1186/s40064-016-2026-7.

Kovacs et al., "Stochasticity in protein levels drives colinearity of gene order in metabolic operons of Escherichia coli." PLoS Biol. (2009). 7(5):e1000115. pp. 1-9.

Kranz, R. G., et al, "Ammonia-constitutive nitrogen fixation mutants of rhodobacter capsulatus," Gene, (1988), vol. 71, pp. 65-74, doi: 10.1016/0378-1119(88)90078-9.

Kumar, R., et al., "Metabolic regulation of *Escherichia coli* and its gdhA, glnL, gltB, D mutants under different carbon and nitrogen limitations in the continuous culture," Microbial Cell Factories 2010, vol. 9, No. 8, pp. 1-17.

Kumar, V., et al., "Establishment of phosphate-solubilizing strains of Azotobacter chroococcum in the rhizosphere and their effect on wheat cultivars under green house conditions," Microbiological Research (2001), 156:87-93.

Kurzweil, A. Plant Bacteria breakthrough enables crops worldwide to take nitrogen from the air. Aug. 1, 2013. http://www.kurzweilai.net/plant-bacteria-breakthrough-enables-crops-worldwide-to-take-nitrogen-from- the-air. 4 Pages.

Kutter et al. Colonization of barley (*Hordeum vulgare*) with *Salmonella enterica* and *Listeria* spp. FEMS Microbial. Ecol. 56, 262-271 (2006).

Lauber, C. L., et al., "Pyrosequencing-Based Assessment of Soil pH as a Predictor of Soil Bacterial Community Structure at the Continental Scale," Environmental Microbiology, Aug. 2009, vol. 75, Issue 15, https://doi.org/10.1128/AEM.00335-09 (18 total pages).

Lauritsen, et al., "A versatile one-step CRISPR-Cas9 based approach to plasmid-curing". Microb Cell Fact (2017); 16:135, 10 pages.

Leang, C. et al. "Genome-wide analysis of the RpoN regulon in Geobacter sulfurreducens," BMC Genomics. Jul. 22, 2009; 10:331, 19 pages.

Lee et al., "The class lld bacteriocin thuricin-17 increases plant growth," Planta, 2009, 229:747-755.

Leigh, J. A., et al., "Nitrogen Regulation in Bacteria and Archaea," Annu. Rev. Microbiol. 2007, 61:349-77.

Lenski, R. E., et al., "Effects of Segregation and Selection on Instability of Plasmid pACYC184 in *Escherichia coli* B," Journal of Bacteriology, Nov. 1987, 169(11):5314-5316.

Leo Daniel, Amalraj E et al., "Effect of Polymeric Additives, Adjuvants, Surfactants on Survival, Stability and Plant Growth Promoting Ability of Liquid Bioinoculants," J Plant Physiol Pathol 2013, 1:2, 5 pages; http://dx.doi.org/10.4172/jppp.1000105.

Levican et al, "Comparative genomic analysis of carbon and nitrogen assimilation mechanisms in three indigenous bioleaching bacteria: predictions and validations" BMC Genomics 2008, 9:581, 19 pages (Year: 2008).

Levin-Karp, A., et al. Quantifying translational coupling in *E. coli* synthetic operons using RBS modulation and fluorescent reporters. ACS Synth. Biol. 2:327-336 (2013).

Li, S., et al., "Human Enhancers are Fragile and Prone to Deactivating Mutations," Molecular Biology and Evolution, 2015, 32(8):2161-2180, Advance access publication May 14, 2015, doi: 10.1093/molbev/msv118.

Liang, L. W. et al., "Minimal effect of gene clustering on expression in *Escherichia coli*". Genetics. Feb. 2013; 193(2):453-65. doi: 10.1534/genetics.112.147199. Epub Dec. 5, 2012.

Lim et al., Fundamental relationship between operon organization and gene expression. Proc Natl Acad Sci U S A. Jun. 28, 2011;108(26):10626-31. doi:10.1073/pnas.1105692108. Epub Jun. 13, 2011.

Lin, P., et al.; "PC, a Novel Oral Insecticidal Toxin from Bacillus bombysepticus Involved in Host Lethality via APN and BtR-175," Sci. Rep.; 5:11101, 14 pages; doi:10.1038/srep11101 (2015).

Lindström, E. S., et al., "Distribution of Typical Freshwater Bacterial Groups Is Associated with pH, Temperature, and Lake Water Rentention Time," Microbial Ecology, Dec. 2005, vol. 71, Issue 12, https://doi.org/10.1128/AEM.71.12.8201-8206.2005 (13 total pages).

Lindström, E. S., "Investigating Influential Factors on Bacterioplankton Community Composition: Results from a Field Study of Five Mesotrophic Lakes," Microbial Ecology (2001), 42:598-605, DOI: 10.1007/s00248-001-0031-y.

Liu, et al. Whole genome analysis of halotolerant and alkalotolerant plant growth-promoting rhizobacterium *Klebsiella* sp. D5A. Sci Rep. May 24, 2016; 6: 1-10.

Liu, H.-M., et al., "Phenazine-1-carboxylic acid biosynthesis in Pseudomonas Chlororaphis GP72 is positively regulated by the sigma factor RpoN," World Journal of Microbiology and Biotechnology (2008), vol. 24. pp. 1961-1966, DOI 10.1007/s11274-008-9655-0.

Liu,, L. et al., "Development of an engineered soil bacterium enabling to convert both insoluble inorganic and organic phosphate into plant available phosphate and its use as a biofertilizer," Molecular Biotechnology 2015, 57:419-429, DOI 10.1007/s12033-014-9834-1.

Lombo et al., (1999) The mithramycin gene cluster of Streptomyces argillaceus contains a positive regulatory gene and two repeated DNA sequences that are located at both ends of the cluster. J. Bacterial. 181:642-647.

Lowman et al., "Strategies for enhancement of switchgrass (*Panicum virgatum* L.) performance under limited nitrogen supply based on utilization of N-fixing bacterial endophytes", Plant and soil, vol.

(56) References Cited

OTHER PUBLICATIONS

405, No. 1, pp. 47-63, published online Aug. 21, 2015, doi: 10.1007/s11104-015-2640-0 (17 total pages).

Lucks et al., Toward scalable parts families for predictable design of biological circuits. Curr. Opin. Microbiol. 11, 567-573 (2008).

Lugtenberg, B. J. J., et al., "Molecular determinants of rhizosphere colonization by Pseudomonas," Annu. Rev. Phytopathol. 2001, 39, 461-90, doi: 10.1146/annurev.phyto.39.1.461.

Ma et al., "Effect of nicotine from tobacco root exudates on chemotaxis, growth, biocontrol efficiency, and colonization byPseudomonas aeruginosaNXHG29," Antonie van Leeuwenhoek, 2018, 111(7):1237-1257.

Mabrouk, Y. et al., "Chapter 6: Potential of Rhizobia in Improving Nitrogen Fixation and Yields of Legumes," Symbiosis, IntechOpen, pp. 1-16, (May 2018) https://www. intechopen.com/books/symbiosis/potential-of-rhizobia-in-improving- nitrogen-fixation-and-yields-of-legumes (15 total pages).

Machado, H. B., et al., "Excretion of ammonium by Azospirillum brasilense mutants resistant to ethylenediamine," Can. J Microbio. 1991, 37, pp. 549-553 (including Abstract, 2 pages).

MacNeil, et al. Fine-structure mapping and complementation analysis of nif (nitrogen fixation) genes in Klebsiella pneumoniae. J Bacteriol. Oct. 1978; 136(1): 253-266.

MacNeil, et al. Mutations in nif genes that cause Klebsiella pneumoniae to be derepressed for nitrogenase synthesis in the presence of ammonium. J Bacteriol. Nov. 1980; 144(2): 744-751.

Maduro M (2011) Random DNA Generator, retrieved from URL http://www.faculty.ucr.edu/lfmmaduro/random.htm, 1 page.

Magari et al., Pharmacologic control of a Humanized Gene Therapy System Implanted into Nude Mice, J. Clin. Invest., 100:2865-2872 (1997).

Mandal M. and Breaker R. R., "Gene regulation by riboswitches", Nat Rev Mol Cell Biol, vol. 5, pp. 451-463, Jun. 2004, doi: 10.1038/nrm1403.

Mao, et al. "Silencing a cotton bollworm P450 monooxygenase gene by plant-mediated RNAi impairs larval tolerance of gossypol," Nature Biotechnology (2007); 25(11): 1307-1313. Epub Nov. 4, 2007.

Marroqui et al. "Enhanced Symbiotic Performance by Rhizobium tropici Glycogen Synthase Mutants," Journal of Bacteriology, Feb. 1, 2001, vol. 183, No. 3, pp. 854-864.

Martinelli, A.H.S., et al.; "Structure-function studies on jaburetox, a recombinant insecticidal peptide derived from jack bean (*Canavalia ensiformis*) urease," Biochim Biophys Acta.; 1840(3):935-944; doi: 10.1016/j.bbagen.2013.11.010 (2014).

Martinez, M.,et al., "Symbiotic Autoregulation of nifA Expression in Rhizobium leguminosarum bv. viciae," Journal of Bacteriology, Oct. 2004, vol. 186, No. 19, pp. 6586-6594, DOI: 10.1128/JB.186. 19.6586-6594.2004.

Martinez-Argudo, I., et al., "The NifL-NifA System: a Multidomain Transcriptional Regulatory Complex that Integrates Environmental Signals," Journal of Bacteriology, Feb. 2004, vol. 186, No., 3, pp. 601-610, DOI: 10.1128/JB.186.3.601-610.2004.

Martinez-Noel et al., NifB and NifEN protein levels are regulated by ClpX2 under nitrogen fixation conditions in Azotobacter vinelandii. Mol Microbiol. Mar. 2011;79(5):1182-93, doi: 10.1111/j.1365-2958. 2011.07540.x. Epub Jan. 25, 2011.

Marx, C. J., et al., "Broad-Host-Range cre-lox System for Antibiotic Marker Recycling in Gram-Negative Bacteria," Biotechniques, 33:1062-1067 (Nov. 2002).

Masepohl, et al., Organization and regulation of genes encoding the molybdenum nitrogenase and the alternative nitrogenase in Rhodobacter capsulatus. Arch. Microbiol. 1996;165:80-90.

Mason C. A. & Hamer G. (1987) Cryptic Growth in Klebsiella-Pneumoniae. Appl Microbiol Biotechnol 25:577-584.

Matsubayashi, et al. Peptide hormones in plants. Annu Rev Plant Biol. 2006; 57:649-74.

Medema et al., Computational tools for the synthetic design of biochemical pathways. Nat Rev Microbiol. Jan. 23, 2012; 10(3):191-202, doi:10.1038/nrmicro2717.

Medema M. H. et al., "Exploiting plug-and-play synthetic biology for drug discovery and production in microorganisms", Nature reviews. Microbiology, vol. 9, pp. 131-137, Feb. 2011, doi: 10.1038/nrmicro2478.

Medema M. H. et al., "Synthetic biology in Steptomyces bacteria", Methods Enzymol, (2011), vol. 497, pp. 485-502.

Meng, X., et al., "Draft Genome Sequence of Rice Endophyte-Associated Isolate Kosakonia oryzae KO348," Genome Announcements, May'Jun. 2015, vol. 3, Issue 3, e00594-15, 1 page.

Mengel, D., "Roots, Growth and Nutrient Uptake," Dept. of Agronomy publication #AGRY-95-08 (Rev. May 1995), 8 pages.

Merriam-Webster. "Originate", accessed Jul. 7, 2020 (Year: 2020). 13 pages.

Merrick, M., et al., "Repressor Properties of the nifL Gene Product in Klebsiella pneumonaie," Mol Gen Genet, 185, pp. 75-81 (1982).

Merrick, M. J., et al., "Nitrogen control of the nif regulon in Klebsiella pneumoniae: involvement of the ntrA gene and analogies between ntrC and nifA," The EMBO Journal (1983), vol. 2, No. 1, pp. 39-44.

Michael Fischbach et al, "Prokaryotic gene clusters: A rich toolbox for synthetic biology", Biotechnology Journal, (Dec. 10, 2010), vol. 5, No. 12, doi:10.1002/biot.201000181, ISSN 1860-6768, pp. 1277-1296.

Miller S. H., et al., "Biochemical and genomic comparison of inorganic phosphate solubilization in *Pseudomonas* species," Environmental Microbiology Reports (2010), 2(3):403-411, doi:10.1111/j.1758-2229.2009.00105.x.

Mirsky, Ethan M., Refactoring the *Salmonella* Type ILL Secretion System. (Doctoral Dissertation) Apr. 12, 2012, 60 pages.

Mirzahoseini, et al., "Heterologous Proteins Production in *Escherichia coli*: An Investigation on the Effect of Codon Usage and Expression Host Optimization," Cell Journal (Yakhteh), 12(4), Winter 2011, pp. 453-458, 2011.

Mitra, Ranjana. Regulation of nifLA operon in Azotobacter vinelandii. Thesis submitted to the Jawaharlal Nehru University, New Delhi, for the degree of doctor of philosophy. 2000. 153 pages.

Miyazaki K, "Creating random mutagenesis libraries by megaprimer PCR of whole plasmid (Megawhop)", Methods Mol Biol, (2003), vol. 231, pp. 23-28.

Monds, R. D., et al., "Conservation of the Pho regulon in Pseudomonas fluorescens Pf0-1," Applied and Environmental Microbiology, Mar. 2006, pp. 1910-1924, doi:10.1128/AEM.72.3.1910-1924.2006.

Montanez, A., et al., "Biological nitrogen fixation maize (*Zea mays* L.) by 15N isotope-dilution and identification of associated culturable diazotrophs," Biol Fertil Soils 2009, 45, pp. 253-263, DOI 10.1007/s00374-008-0322-2.

Montoya, J. P., et al., "A Simple, High-Precision, High-Sensitivity Tracer Assay for N2 Fixation," Applied and Environmental Microbiology, Mar. 1996, vol. 62, No. 3, pp. 986-993.

Moon et al., Genetic programs constructed from layered logic gates in single cells. Nature. Nov. 8, 2012; 491(7423):249-53, doi: 10.1038/nature11516. Epub Oct. 7, 2012.

Mosquito, S., et al., "In Planta Colonization and Role of T6SS in Two Rice Kosakonia Endophytes," MPMI 2020, vol. 33, No. 2, pp. 349-363, https://doi.org/10.1094/MPMI-09-19-0256-R.

Mueller, et al. Closing yield gaps through nutrient and water management. Nature 490, 254-257 (2012).

Murphy, J., et al., "A modified single solution method for the determination of phosphate in natural•waters," Analytica Chimica Acta, 27 (1962), pp. 31-36.

Mus, F., et al., "Diazotrophic Growth Allows Azotobacter vinelandii to Overcome the Deleterious Effects of a glnE Deletion," Applied and Environmental Microbiology, Jul. 2017, vol. 83, No. 13, e00808-17, 13 pages, DOI: 10.1128/AEM.00808-17.

Mus, F., et al. Symbiotic Nitrogen Fixation and the Challenges to Its Extension to Nonlegumes. Appl. Environ. Microbiol., Jul. 2016, 82(13):3698-3710.

Muse, W. B., et al., "The nac (Nitrogen Assimilation Control) Gene from *Escherichia coli*," Journal of Bacteriology, Mar. 1998, vol. 180, No. 5, pp. 1166-1173.

Mutalik, V.K., et al. Quantitative estimation of activity and quality for collections of functional genetic elements. Nat. Methods 10:347-353 (2013).

(56)                References Cited

OTHER PUBLICATIONS

Nagy, Zs. K., et al., "Nanofibrous solid dosage form of living bacteria prepared by electrospinning," eXPRESS Polymer Letters, (2014), vol. 8, No. 5, pp. 352-361, DOI: 10.3144/expresspolymlett.2014.39.

Naimov, et al. "Solubilization, activation, and insecticidal activity of Bacillus thuringiensis serovar thompsoni HD542 crystal proteins." Appl Environ Microbiol. Dec. 2008;74(23):7145-51. doi: 10.1128/AEM.00752-08.

Nassar et al. Promotion of plant growth by an auxin-producing isolate of the yeast Williopsis saturnus endophytic in maize (*Zea mays* L.) roots. Biology and Fertility of Soils, 2005, 42:97-108.

Nelissen, et al., Translational research: from pot to plot. Plant Biotechnology Journal 2014, 12:277-285.

Nestmann, et al. "Mutagenesis by nitrosoguanidine, ethyl methanesulfonate, and mutator gene mutH in continuous cultures of *Escherichia coli*." Mutat Res. Jun. 1975;28(3):323-30. doi: 10.1016/00275107(75)90226-2.

Newton, R. J., et al., "A Guide to the Natural History of Freshwater Lake Bacteria," Microbiology and Molecular Biology Reviews, Mar. 2011, vol. 75, No. 1, pp. 14-49, doi:10.1128/MMBR.00028-10.

Nichkawade, Anuradha. "Studies on upstream regulatory sequence of the nifLA promoter of Klebsiella pnuemoniae", Thesis submitted to the Jawaharlal Nehru University, New Delhi, for the degree of Doctor of Philosophy. 1996. 166 pages.

Nielsen, H., et al., "Extraction of EPS," Wingender et al. (eds.), Microbial Extracellular Polymeric Substances, 1999, Chapter 3, 24 pages.

Nielsen, K.M., Transgenic organisms—time for conceptual diversification? Nature Biotechnology 2003; 21: 227-228.

Nielsen, P. H. et al., "Conceptual model for production and composition of exopolymers in biofilms," Wat. Sci. Tech., vol. 36, No. 1, pp. 11-19 (1997).

Nita, P. et al., "Liquid formulations of Acetobacter diazotrophicus L1 and Herbaspirillum seropedicae J24 and their field trials on wheat," International Journal of Environmental Science, 2012, 3(3):1116-1129, DOI: 10.6088/ijes.2012030133019.

No., et al., "Ecdysone-inducible gene expression in mammalian cells and transgenic mice" Proc. Natl. Acad. Sci. USA vol. 93, Issue 8, pp. 3346-3351, Apr. 1996.

Noindorf, L., et al., "Role of Pll proteins in nitrogen fixation control of *Herbaspirillum seropedicae* strain SmR1," BMC Microbiology 2011, vol. 11:8, pp. 1-8, http://www.biomedcentral.com/1471-2180/11/8.

Non-Final Office Action, dated Aug. 27, 2024, for U.S. Appl. No. 17/278,022, 30 pages.

Non-Final Office Action, dated Dec. 11, 2023, for U.S. Appl. No. 16/759,212, 11 pages.

Non-Final Office Action, dated Dec. 18, 2017, for U.S. Appl. No. 15/636,595 (10 pages).

Non-Final Office Action, dated Dec. 22, 2022, for U.S. Appl. No. 16/759,231 (12 total pages).

Non-Final Office Action, dated Dec. 30, 2019, for U.S. Appl. No. 15/766,122 (15 total pages).

Non-Final Office Action, dated Feb. 1, 2022, for U.S. Appl. No. 16/192,738 (8 total pages).

Non-Final Office Action, dated Jan. 10, 2020, for U.S. Appl. No. 16/192,738 (8 total pages).

Non-Final Office Action, dated Jan. 24, 2024, for U.S. Appl. No. 16/759,231, 11 pages.

Non-Final Office Action, dated Jan. 7, 2021, for U.S. Appl. No. 16/192,738 (17 total pages).

Non-Final Office Action, dated Jul. 8, 2020, for U.S. Appl. No. 15/766,122 (16 total pages).

Non-Final Office Action, dated Jul. 9, 2021, for U.S. Appl. No. 16/192,738 (8 total pages).

Non-Final Office Action, dated Jun. 21, 2023, for U.S. Appl. No. 16/759,231 (11 total pages).

Non-Final Office Action, dated Jun. 23, 2023, for U.S. Appl. No. 16/746,215 (34 total pages).

Non-Final Office Action, dated Jun. 24, 2021, for U.S. Appl. No. 15/766,122 (30 total pages).

Non-Final Office Action, dated Mar. 8, 2019, for U.S. Appl. No. 16/159,542 (33 pages).

Non-Final Office Action, dated May 11, 2023, for U.S. Appl. No. 17/027,030 (30 total pages).

Non-Final Office Action, dated May 26, 2020, for U.S. Appl. No. 16/685,997 (16 total pages).

Non-Final Office Action, dated Nov. 10, 2022, for U.S. Appl. No. 16/746,215 (26 total pages).

Non-Final Office Action, dated Nov. 17, 2023, for U.S. Appl. No. 17/278,022, 34 pages.

Non-Final Office Action for U.S. Appl. No. 17/255,304 dated Jul. 13, 2023, 19 pages.

Noskov, V.N. et al. Assembly of large, high G+C bacterial DNA fragments in yeast. ACS Synth. Biol. 1:267-273 (2012).

Notice of Acceptance, dated Dec. 29, 2021, for Bangladesh Application No. 113/2020 (1 total pages).

Notice of Acceptance, dated Jan. 29, 2020, for Australian Patent Application No. 2016294506 (3 total pages).

Notice of Acceptance, dated Nov. 21, 2023, for Australian Patent Application No. 2018207204, 4 pages.

Notice of Acceptance, dated Oct. 12, 2023, for Australian Patent Application No. 2022271476 (3 total pages).

Notice of Acceptance, dated Oct. 13, 2023, for Australian Patent Application No. 2018354338 (3 total pages).

Notice of Allowance, dated Apr. 10, 2023, for Japanese Patent Application No. 2020- 189397 (6 total pages).

Notice of Allowance, dated Apr. 4, 2024, for U.S. Appl. No. 16/759,212, 5 pages.

Notice of Allowance, dated Apr. 5, 2023, for U.S. Appl. No. 17/148,173 (8 total pages).

Notice of Allowance, dated Dec. 27, 2023, for Japanese Patent Application No. 2020-524148, 6 pages.

Notice of Allowance, dated Feb. 16, 2022, for U.S. Appl. No. 15/766,122 (8 total pages).

Notice of Allowance, dated Feb. 7, 2023, for Japanese Patent Application No. 2022-068364, 6 pages.

Notice of Allowance, dated Jan. 25, 2023, for Japanese Patent Application No. 2019-537786, 8 total pages.

Notice of Allowance, dated Jan. 6, 2021, for U.S. Appl. No. 16/685,997 (12 total pages).

Notice of Allowance, dated Jul. 16, 2024, for U.S. Appl. No. 16/759,231, 10 pages.

Notice of Allowance, dated Jul. 20, 2023, for Korean Patent Application No. 10-2022-7037148 (8 total pages).

Notice of Allowance, dated Jul. 25, 2022, for Indonesian Patent Application No. PID201906965 (4 total pages).

Notice of Allowance, dated Jul. 27, 2022, for Korean Patent Application No. 10-2020-7036413 (6 total pages).

Notice of Allowance, dated Jun. 9, 2022, for U.S. Appl. No. 15/766,122 (8 total pages).

Notice of Allowance, dated Mar. 29, 2024, for U.S. Appl. No. 16/759,212, 8 pages.

Notice of Allowance, dated Mar. 30, 2018, for U.S. Appl. No. 15/636,595 (24 pages).

Notice of Allowance, dated May 28, 2024, for Korean Patent Application No. 10-2019-7023576, 9 pages.

Notice of Allowance, dated May 4, 2023, for Canadian Patent Application No. 2,838,955 (1 total pages).

Notice of Allowance, dated Oct. 16, 2020. for Japanese Patent Application No. 2018-502160 (6 total pages).

Notice of Allowance, dated Oct. 23, 2020, for U.S. Appl. No. 16/685,997 (11 total pages).

Notice of Allowance, dated Sep. 8, 2022, for U.S. Appl. No. 16/192,738 (8 total pages).

Notice of Final Rejection, mailed Dec. 21, 2023, for Japanese Patent Application No. 2020-573030, 13 pages.

Notice of Opinion, dated Sep. 27, 2023, for Korean Patent Application No. 10-2020-7014831 (20 total pages).

Notice of Opinion, dated Sep. 28, 2023, for Korean Patent Application No. 10-2020-7014678 (11 total pages).

(56) References Cited

OTHER PUBLICATIONS

Notice of Panel Decision from Pre-Appeal Brief Review, dated May 7, 2024, for U.S. Appl. No. 16/759,231, 2 pages.
Notice of Reasons for Refusal, dated Mar. 8, 2023, for Japanese Patent Application No. 2018-536712 (15 total pages).
Notice of Reasons for Rejection, dated Feb. 4, 2022, for Japanese Patent Application No. 2020-189397 (9 total pages).
Notice of Reasons for Rejection, dated Jan. 7, 2020, for Japanese Patent Application No. 2018-502160 (18 pages).
Notice of Reasons for Rejection, dated May 11, 2020, for Japanese Patent Application No. 2018-502160 (10 total pages).
Notice of Reasons for Rejection, dated May 24, 2023, for Japanese Patent Application No. 2020-573030 (12 total pages).
Notice of Reasons for Rejection, dated Nov. 21, 2022, for Japanese Patent Application No. 2020-524160 (14 total pages).
Notification of Decision to Grant or Register with Search Report, dated May 24, 2021, for ARIPO Patent Application No. AP/P/2018/010427 (6 total pages).
Notification of Decision to Grant or Register with Search Report, dated Nov. 16, 2022, for ARIPO Patent Application No. AP/P/2020/012402 (6 total pages).
Notification of Decision to Grant or Register with Search Report, dated Sep. 5, 2022, for ARIPO Patent Application No. AP/P/2020/012401 (5 total pages).
Notification of Grant of Patent for Invention, mailed Nov. 4, 2022, for Chinese Patent Application No. 201680064863.2 (4 total pages).
Notification of Non-Compliance and Search Report, dated Nov. 26, 2020, for ARIPO Patent Application No. AP/P/2018/010427 (6 total pages).
Notification of Non-Compliance with Substantive Requirements and Invitation to Submit Observations and/or Amended Application, dated Apr. 28, 2022, for ARIPO Application No. AP/P/2020/012245 (5 total pages).
Notification of Non-Compliance with Substantive Requirements and Invitation to Submit Observations and/or Amended Application with Search Report, dated Feb. 15, 2022, for ARIPO Patent Application No. AP/P/2020/012402 (5 total pages).
Notification of Non-Compliance with Substantive Requirements and Invitation to Submit Observations and/or Amended Application with Search Report, dated Feb. 8, 2022, for ARIPO Patent Application No. AP/P/2020/012401 (4 total pages).
Notification of Provisional Rejection, mailed Aug. 1, 2023, for Korean Patent Application No. 10-2020-7006825 (5 total pages).
Notification of Reasons for Refusal (1st Office Action), dated Jul. 31, 2020, for Japanese Patent Application No. 2018-536712 (9 total pages).
Notification of Reasons for Refusal (1st Office Action), dated Sep. 5, 2022, for Japanese Application No. 2021-135296, 8 pages.
Notification of Reasons for Refusal (1st Office Action from the Board of Appeal), dated Aug. 19, 2022, for Japanese Application No. 2018-536712, 18 pages.
Notification of Reasons for Refusal, dated Jun. 28, 2022, for Japanese Patent Application No. 2019-537786, 6 pages.
Notification on violation of the unity requirement, mailed Nov. 25, 2022, for Russian Application No. 2021101586 (11 pages).
O'Brien, F. J. M., et al., "Soil Salinity and pH Drive Soil Bacterial Community Composition and Diversity Along a Lateritic Slope in the Avon River Critical Zone Observatory, Western, Australia," Frontiers in Microbiology, Jul. 2019, vol. 10, Art. 1486, pp. 1-20, doi: 10.3389/fmicb.2019.01486.
Office Action and Search report for Chinese Application No. CN202080031072.6 dated Nov. 8, 2023, 18 pages.
Office Action, dated Apr. 24, 2022, for Chinese Patent Application No. 201680064863.2 (13 total pages).
Office Action, dated Apr. 8, 2024, for Japanese Patent Application No. 2021-563211, 12 pages.
Office Action, dated Aug. 1, 2024, for Japanese Patent Application No. 2023-069005, 11 pages.
Office Action, dated Aug. 18, 2022, for Indonesia Patent Application No. P00202100102 (4 total pages).

Office Action, dated Aug. 19, 2023, for Ukraine Patent Application No. a201908538 (13 total pages).
Office Action, dated Aug. 25, 2023, for Mexican Patent Application No. MX/A/2020/001599 (20 total pages).
Office Action, dated Aug. 30, 2023, for Vietnam Application No. 1-2020-02899 (4 total pages).
Office Action, dated Dec. 1, 2023, for Brazilian Patent Application No. BR122022018729-3, 18 pages.
Office Action, dated Dec. 15, 2021, for Chinese Patent Application No. 2016800527106 (8 total pages).
Office Action, dated Dec. 27, 2023, for Korean Patent Application No. 10-2019-7023576, 10 pages.
Office Action, dated Dec. 8, 2021, for Chinese Patent Application No. 201680064863.2 (12 total pages).
Office Action, dated Feb. 14, 2022, for Turkish Patent Application No. 2018/00432 (7 total pages).
Office Action, dated Feb. 6, 2024, for European Patent Application No. 19186353.9, 6 pages.
Office Action, dated Feb. 8, 2022, for Indian Patent Application No. 201917031229, 10 pages.
Office Action, dated Jan. 12, 2022, for Ukraine Patent Application No. a201801310 (15 total pages).
Office Action, dated Jan. 30, 2023, for Indonesian Patent Application No. P00202003665 (6 total pages).
Office Action, dated Jul. 15, 2024, for Mexican Patent Application No. MX/a/2020/012304, 6 pages.
Office Action, dated Jul. 26, 2024, for Korean Patent Application No. 10-2020-7014831, 9 pages.
Office Action, dated Jul. 30, 2024, for Mexican Patent Application No. MX/a/2020/004343, 10 pages.
Office Action, dated Jun. 10, 2021, for Russian Patent Application No. 2018105055 (11 total pages).
Office Action, dated Jun. 27, 2023, for Korean Patent Application No. 10-2019-7023576 (11 total pages).
Office Action, dated Jun. 27, 2024, for Korean Patent Application No. 10-2020-7014678, 9 pages.
Office Action, dated Mar. 12, 2024, for Japanese Patent Application No. 2023-008125, 8 pages.
Office Action, dated Mar. 15, 2024, for Japanese Patent Application No. 2023-036406, 7 pages.
Office Action, dated Mar. 23, 2022, for Russian Patent Application No. 2019125282 (15 total pages).
Office Action, dated Mar. 29, 2024, for Chinese Patent Application No. 202080030837.4, 19 pages.
Office Action, dated May 10, 2024, for Korean Patent Application No. 10-2023-7036383, 10 pages.
Office Action, dated May 12, 2020, for Indonesia Patent Application No. PID201800905 (6 total pages).
Office Action, dated May 13, 2022, for Mexican Patent Application No. MX/a/2019/008285 (10 total pages).
Office Action, dated May 23, 2023, for Indonesian Patent Application No. P00202108852 (8 total pages).
Office Action, dated May 26, 2021, for Russian Patent Application No. 2019125282 (21 total pages).
Office Action, dated Nov. 11, 2022, for Russian Patent Application No. 2020116764 (6 total pages).
Office Action, dated Nov. 21, 2023, for Ukraine Patent Application No. 202001335, 18 pages.
Office Action, dated Nov. 24, 2022, for Pakistan Patent Application No. 354/2021 (1 total page).
Office Action, dated Nov. 27, 2023, for Japanese Patent Application No. 2020-524148, 11 pages.
Office Action, dated Nov. 4, 2022, for Pakistan Patent Application No. 336/2021 (1 total page).
Office Action, dated Oct. 1, 2024, for Japanese Patent Application No. 2023-137168, 7 pages.
Office Action, dated Oct. 16, 2019 for European Application No. 16854192.8, 8 pages.
Office Action, dated Oct. 24, 2022, for Japanese Application No. 2020-524148, 15 pages.
Office Action, dated Oct. 30, 2023, for Mexican Patent Application No. MX/A/2020/004344, 12 pages.

(56)        References Cited

OTHER PUBLICATIONS

Office Action, dated Sep. 12, 2024, for Japanese Patent Application No. 2023-008125, 11 pages.
Office Action, dated Sep. 15, 2020, for Indonesia Patent Application No. PID201800905 (24 pages).
Office Action, dated Sep. 19, 2024, for Chinese Patent Application No. 202080030837.4, 12 pages.
Office Action, dated Sep. 2, 2022, for Mexican Patent Application No. MX/A/2019/008285, dated Sep. 2, 2022, 16 pages.
Office Action, dated Sep. 24, 2024, for Chinese Patent Application No. 202210708554.1, 16 pages.
Office Action, dated Sep. 27, 2023, for Vietnam Application No. 1-2020-02898 (4 total pages).
Office Action, dated Sep. 29, 2023, for Vietnam Patent Application No. 1-2019-04336 (4 total pages).
Office Action, dated Sep. 4, 2021, for Indonesian Patent Application No. PID201906965 (6 total pages).
Office Action for Australian Patent Application No. 2018354221, dated Apr. 19, 2024, 5 pages.
Office Action for Australian Patent Application No. 2018354221, dated Nov. 6, 2024, 5 pages.
Office Action for Australian Patent Application No. 2022203325, dated Jan. 24, 2024, 3 pages.
Office Action for Brazilian Patent Application No. BR112019014378-5 dated May 15, 2024, 12 pages.
Office Action for Brazilian Patent Application No. BR112018006800-4 dated Apr. 30, 2024, 27 pages.
Office Action for Brazilian Patent Application No. BR112019014378-5 dated Feb. 6, 2024, 17 pages.
Office Action for Brazilian Patent Application No. BR112020008035-7 dated Jul. 29, 2024, 7 pages.
Office Action for Brazilian Patent Application No. BR122022018729-3, dated Apr. 17, 2024, 22 pages.
Office Action for Brazilian Patent Application No. BR122022025322-9 dated Apr. 30, 2024, 29 pages.
Office Action for Brazilian Patent Application No. BR122024009210-7 dated May 21, 2024, 2 pages.
Office Action for Canadian Patent Application No. 2,991,776 dated Apr. 8, 2024, 10 pages.
Office Action for Canadian Patent Application No. 3,001,001 dated Apr. 16, 2024, 7 pages.
Office Action for Canadian Patent Application No. 3,049,258, dated Sep. 4, 2024, 4 pages.
Office Action for Canadian Patent Application No. 3,104,531, dated Oct. 24, 2024, 4 pages.
Office Action for Canadian Patent Application No. 3,137,739 dated Aug. 15, 2024, 5 pages.
Office Action for Canadian Patent Application No. 3,172,322, dated Jan. 11, 2024, 7 pages.
Office Action for Canadian Patent Application No. 3,172,323 dated Nov. 8, 2023, 3 pages.
Office Action for Chinese Application No. 201880081988.5, dated Dec. 7, 2022, 9 pages.
Office Action for Chinese Application No. 201880081988.5, dated Jul. 26, 2023, 17 pages.
Office Action for Chinese Application No. 201880082093.3, dated Aug. 16, 2022, 11 pages.
Office Action for Chinese Application No. 201880082093.3, dated Dec. 19, 2023, 12 pages.
Office Action for Chinese Application No. 201880082093.3, dated May 10, 2023, 8 pages.
Office Action for Chinese Application No. 201980053945.0 dated Feb. 22, 2023, 11 pages.
Office Action for Chinese Application No. 201980053945.0 dated Jun. 14, 2022, 14 pages.
Office Action for Chinese Patent Application No. 201680052710.6, dated Jun. 28, 2021, 8 pages.
Office Action for Chinese Patent Application No. 201880082093.3 dated Jun. 21, 2024, 10 pages.

Office Action for Thailand Patent Application No. 1901004319 dated Dec. 18, 2023, 7 pages.
Office Action for Thailand Patent Application No. 2001002304, dated Dec. 18, 2023, 7 pages.
Office Action, mailed Aug. 26, 2024, for Korean Patent Application No. 10-2021-7002488, 7 pages.
Office Action with Search Report, dated Dec. 3, 2020, for Chinese Patent Application No. 201680064863.2 (23 total pages).
Office Action with Search Report, dated Nov. 7, 2023, for ARIPO Patent Application No. AP/P/2021/013636, 5 pages.
Office Action with Search Report, dated Oct. 26, 2020, for Chinese Patent Application No. 201680052710.6 (15 total pages).
Office Action with Search Report, dated Sep. 15, 2023, for Paraguay Patent Application No. 1801672 (6 total pages).
Office Action with Search Report for Brazilian Patent Application No. BR112018000729-3, dated Jan. 27, 2020, 10 pages.
Office Action with Search Report for Brazilian Patent Application No. BR112020002654-9, dated May 24, 2022, 8 pages.
Office Action with Search Report for Chinese Application No. 2022107085541 dated Jan. 6, 2024, 17 pages.
Oh, et al., "Organization of nif gene cluster in Frankia sp. EulK1 strain, a symbiont of Elaeagnus umbellata," Arch Microbiol., 2012, 194:29-34.
Ohta et al., "Associative N2-fixation of Rice with Soil Microorganisms", Soil and Microorganisms 1985, 27:17-27 (English abstract only).
Ohtsuka, E. et al., "An alternative approach to deoxyoligonucleotides as hybridization probes by insertion of deoxyinosine at ambiguous codon positions," JBC, 260(5):2605-2608 (1985).
Okubo et al. Effects of Elevated Carbon Dioxide, Elevated Temperature, and Rice Growth Stage on the Community Structure of Rice Root-Associated Bacteria. Microbes Environ. 2014; 29(2):184-190. Published online May 31, 2014.doi: 10.1264/jsme2.ME14011.
Opposition—Statement of Grounds and Particulars, dated Aug. 18, 2022, for Australian Patent Application No. 2020203002 (29 total pages).
Orme-Johnson WH, "Molecular basis of biological nitrogen fixation", Annu Rev Biophys Biophys Chem, (1985), vol. 14, pp. 419-459.
Ortiz-Marquez, et al., "Association with an Ammonium-excreting bacterium allows diazotrophic culture of oil-rich Eukaryotic microalgae," Applied and Environmental Microbiology 2012, 78(7), pp. 2345-2352.
Ortiz-Marquez, J. C., et al., "Metabolic engineering of ammonium release for nitrogen-fixing multispecies microbial cell-factories," Metabolic Engineering 23 (2014), pp. 154-164.
Pakula, A. A., et al., "Genetic Analysis of Protein Stability and Function," Annu. Rev. Genet. 1989, 23: 289-310.
Pankievicz, V. C. S., et al., "Robust biological nitrogen fixation in a model grass-bacterial association," The Plant Journal (2015), 81, pp. 907-919, doi: 10.1111/tpj.12777.
Parker, M.W., et al.; "Pore-forming protein toxins: from structure to function," Prog Biophys Mol Biol.; 88(1):91-142; doi: 10.1016/j.pbiomolbio.2004.01.009 (2005).
Parsons, R., "Physiological Regulation of Nitrogen Fixation in Soybean Root Nodules," The Australian National University, Sep. 1989, ProQuest No. 28831644, 173 pages.
Partial Supplementary European Search Report, dated Oct. 27, 2020, for European Application No. 18739050.5, 19 pages.
Partial Supplementary European Search Report for European Patent Application No. 16825147.8, dated Mar. 4, 2019, 21 pages.
Partial Supplementary European Search Report for European Patent Application No. 19826654.6, dated Mar. 17, 2022, 11 Pages.
Partial Supplementary European Search Report in European Application No. 18843845.1, dated Apr. 12, 2021, 14 pages.
Partial Supplementary European Search Report in European Appln. No. 18870036.3, dated Aug. 19, 2021, 16 pages.
Paschen, Annette, et al., "Rhodobacter capsulatus nifA mutants mediating nif gene expression in the presence of ammomium," FEMS microbiology letters, Jan. 2001, pp. 207-213, doi: 10.1016/S0378-1097(01)00230-0.

(56) References Cited

OTHER PUBLICATIONS

PCT Invitation to Pay Additional Fees and, Where Applicable, Protest Fee, dated Sep. 30, 2022, for International Application No. PCT/US2022/035873 (16 total pages).

Pedrosa, F. O., et al., "Regulation of Nitrogen Fixation and Ammonium Assimilation in Associative and Endophytic Nitrogen Fixing Bacteria," Chapter 3, C. Elmerich and W. E. Newton (eds.), Associative and Endophytic Nitrogen-fixing Bacteria and Cyanobacterial Associations, pp. 41-71 (2007).

Pfleger et al., "Combinatorial engineering of intergenic regions in operons tunes expression of multiple genes"; Nature Biotechnology; 24(8):1027-1031 (2006).

Philippe N. et al., "Improvement of pCVD442, a suicide plasmid for gene allele exchange in bacteria", Plasmid, vol. 51, 2004, pp. 246-255.

Piccioli et al., "Neuroantibodies: Ectopic Expression of a Recombinant Anti-Substance P Antibody in the Central Nervous System of Transgenic Mice", Neuron, 15:373-84 (1995).

Piccioli, et al. Neuroantibodies: molecular cloning of a monoclonal antibody against substance P for expression in the central nervous system. Proc Natl Acad Sci USA. Jul. 1, 1991; 88(13): 5611-5615.

Pickens, L.B., et al., "Metabolic engineering for the production of natural products," Annu. Rev. Chem. Biomol. Eng. 2011, 2:211-236, 29 pages.

Plotnikova, et a. Pathogenesis of the human opportunistic pathogen Pseudomonas aeruginosa PA14 in *Arabidopsis*. Plant Physiol. 124, 1766-1774 (2000).

Poliner, E., et al., "Nontransgenic Marker-Free Gene Disruption by an Episomal CRISPR System in the Oleaginous Microalga, Nannochloropsis oceanica CCMP1779," ACS Synthetic. Biology, 2018, 7, pp. 962-968, published Mar. 8, 2018, DOI: 10.1021/acssynbio.7b00362.

Price, M. N., et al., "Operon formation is driven by co-regulation and not by horizontal gene transfer," Genome Research, 15, 809-819 (2005).

Price, M. N. et al. "The life-cycle of operons". PLoS Genet. Jun. 2006; 2(6):e96, 15 pages, doi: 10.1371/journal.pgen.0020096. Epub Jun. 23, 2006.

Priyanka J., et al., "Diversity Study of Nitrate Reducing Bacteria from Soil Samples—A Metagenomics Approach," Journal of Computer Science & Systems Biology 2015, vol. 8(4), pp. 191-198, DOI: 10.4172/jcsb.1000188.

Purcell, et al. "Cholesterol oxidase: a potent insecticidal protein active against boll weevil larvae." Biochem Biophys Res Commun. Nov. 15, 1993;196(3):1406-13. doi: 10.1006/bbrc.1993.2409.

Purnick PE & Weiss R (2009) The second wave of synthetic biology: from modules to systems. Nat Rev Mol Cell Biol 10(6):410-422.

Pyne, M. E., et al., "Coupling the CRISPR/Cas9 System with Lambda Red Recombineering Enables Simplified Chromosomal Gene Replacement in *Escherichia coli*," Applied and Environmental Microbiology, Aug. 2015, vol. 81, No. 15, pp. 5103-5114, doi: 10.1128/AEM.01248-15.

Qaim, M., et al.; "Yield effects of genetically modified crops in developing countries," Science; 299(5608):900-902 (2003); 10.1126/science.1080609.

Qiu, D. -Y. & Shen, B. -F., "Construction of Genetically Engineered Strains of *Enterobacter cloacae* (nifL—Ac)," Acta Phytophysiologica Sinica, 25(3):269-273 (1999). English translation.

Rajput, M. S., et al., "Derepression of Mineral Phosphate Solubilization Phenotype by Insertional Inactivation of icIR in Klebsiella pneumoniae," PLoS One, Sep. 18, 2015, 10(9):e0138235, pp. 1-15, doi: 10.1371/journal.pone.0138235.

Ramirez, M. D. A., et al., "Burkholderia and Paraburkholderia are Predominant Soybean Rhizobial Genera in Venezuela Soils in Different Climatic and Topographical Regions," Microbes and Environments, 2019, vol. 34, No. 1, 43-58, doi: 10:1264/jsme2.ME18076.

Ramon and Smith, "Single-step linker-based combinatorial assembly of promoter and gene cassettes for pathway engineering". Biotechnology Letters (Mar. 2011); 33(3): 549-555. Epub Nov. 24, 2010.

Ran et al., "Genome erosion in a nitrogen-fixing vertically transmitted endosymbiotic multicellular cyanobacterium", PLoS One, vol. 5, Issue 7, e11486, pp. 1-11, Jul. 2010, doi: 10.1371/journal.pone.0011486. Erratum in: PLoS One. 2010;5(9) doi: 10.1371/annotation/835c5766-5128-41c4-b636-adfe0c503103.

Resendis-Antonio et al. "Systems biology of bacterial nitrogen fixation: High-throughput technology and its integrative description with constraint-based modeling", BMC Syst Biol. 2011; 5:120. pp. 1-15.

Restriction Requirement, dated Apr. 14, 2022, for U.S. Appl. No. 16/637,565 (8 total pages).

Restriction Requirement, dated Aug. 14, 2023, for Philippines Application No. 1-2020-552234, 4 pages.

Restriction Requirement, dated Aug. 19, 2024, for U.S. Appl. No. 17/605,374, 8 pages.

Restriction Requirement, dated Jul. 17, 2023, for U.S. Appl. No. 16/759,212 (11 total pages).

Restriction Requirement, dated Jun. 2, 2022, for U.S. Appl. No. 16/746,215 (8 total pages).

Restriction Requirement, dated Mar. 30, 2023, for U.S. Appl. No. 17/255,304 (9 total pages).

Restriction Requirement, dated Nov. 21, 2023, for U.S. Appl. No. 17/027,030, 6 pages.

Restriction Requirement, dated Sep. 20, 2024, for U.S. Appl. No. 17/604,119, 9 pages.

Rey, F., et al., "Redirection of Metabolism for Biological Hydrogen Production," Applied and Environmental Bicrobiology, Mar. 2007, vol. 73, No. 5, pp. 1665-1671, doi: 10.1128/AEM.02565-06.

Reyes, I, et al., "Characteristics of phosphate solubilization by an isolate of a tropical Penicillium rugulosum and two UV-induced mutants," FEMS Microbiology Ecology 28 (1999), pp. 291-295.

Richardson, A. E., et al., "Extracellular secretion of Aspergillus phytase from *Arabidopsis* roots enables plants to obtain phosphorus from phytate," The Plant Journal 2001, 25(6), pp. 641-649, DOI: 10.1046/j.1365-313x.2001.00998.x.

Riedel et al., (1983) Nitrogen fixation by Klebsiella pneumoniae is inhibited by certain multicopy hybrid nif plasmids. J Bacterial 153(1):45-56.

Riggs, P. J., et al., "Enhance maize productivity by inoculation with diazotrophic bacteria," Australian Journal of Plant Physiology, 2001, 28, pp. 829-836.

Rivarez, M. P. S., et al., "Defense Biopriming and Antimicrobial Activity of Endophytic Bacteria and Associated Bacillus Species Contribute to Bacterial Crown Rot Tolerance in Papaya," bioRxiv 2019, 24 pages, doi: https://doi.org/10.1101/2019.12.22.886341.

Roberts et al. (1978) Regulation and Characterization of Protein Products Coded by the nif (Nitrogen Fixation) Genes of Kelbsiella pneumoniae. J. Bacteriol. 136(1): 267-279. (Year: 1978).

Robledo, M. et al., "Rhizobium cellulase CelC2 is essential for primary symbiotic infection of legume host roots,," Proceedings of the National Academy of Sciences, May 13, 2008, vol. 105, No. 19, pp. 7064-7069, doi: 10.1073/pnas.0802547105.

Robledo, M. et al., "Role of Rhizobium endoglucanase CelC2 in cellulose biosynthesis and biofilm formation on plant roots and abiotic surfaces," Microbial Cell Factories 2012, 11:125, pp. 1-12, http://www.microbialcellfactories.com/content/11/1/125.

Robson et al., Azotobacter Genomes: The Genome of Azotobacter chroococcum NCIMB 8003 (ATCC 4412). PLOS One (2015), 10 (6): e0127997. doi:10.1371/journal.pone.0127997.

Rodriguez, H., et al., "Expression of a mineral phosphate solubilizing gene from Erwinia herbicola in two rhizobacterial strains," Journal of Biotechnology 2000, 84:155-161.

Rodriguez, H. et al., "Genetics of phosphate solubilization and its potential applications for improving plant growth-promoting bacteria," Plant and Soil (2006), 287:15-21, DOI 10.1007/s11104-006-9056-9.

Rogers, et al., Synthetic biology approaches to engineering the nitrogen symbiosis in cereals. Journal of Experimental Botany, 2014; 65(8):1939-1946.

(56) References Cited

OTHER PUBLICATIONS

Rojas-Tapias, D. et al., "Preservation of *Azotobacter chroococcum* vegetative cells in dry polymers," Univ. Sci. 2015, vol. 20(2): 201-207, doi: 10.11144/Javeriana.SC20-2.pacv.

Rommens, et al. Intergeneric transfer and functional expression of the tomato disease resistance gene PTO. Plant Cell. Oct. 1995; 7(10): 1537-1544.

Roncato-Maccari, et al., Endophytic Herbaspirillum seropedicae expresses nif genes in gramineous plants. FEMS Microbiology Ecology. 2003; 45: 39-47.

Rong et al., "Promoter specificity determinants of T7 RNA polymerase," Proc. Natl. Acad. Sci. USA, 95(2):515-519 (1998).

Rosenblueth et al., Bacterial Endophytes and Their Interaction with Hosts. Mol Plant Microbe Interact. Aug. 2006;19(8):827-37.

Rosenblueth et al. Nitrogen Fixation in Cereals. Frontiers in Microbiology, vol. 9, Article 1794. (Aug. 9, 2018). 13 pages.

Rossolini et al., "Use of Deoxyinosine-Containing Primers vs Degenerate Primers for Polymerase Chain Reaction Based on Ambiguous Sequence Information" Mol. Cell. Probes 8:91-98 (1994).

Rubio, L. M. et al., "Maturation of Nitrogenase: a Biochemical Puzzle", J. Bacteriology, 2005, 187(2):405-414.

Ryu, et al., "Control of nitrogen fixation in bacteria that associate with cereals", Nature Microbiology, vol. 5, No. 2, Dec. 2019, pp. 314-330, doi: 10.1038/s41564-019-0631-2 (31 total pages).

Saikia, et al., Biological nitrogen fixation with non-legumes: An achievable target or a dogma? Curr. Sci. 2007; 92(3): 317-322.

Saleh, S. S., et al., "Involvement of gacS and rpoS in enhancement of the plant growth-promoting capabilities of Enterobacter cloacae CAL2 and UW4," Canadian Journal of Microbiology (2001), 47:698-705, DOI: 10.1139/cjm-47-8-698.

Salis, et al., "Automated Design of Synthetic Ribosome Binding Sites to Precisely Control Protein Expression". Nat Biotechnol. (Oct. 2009); 27(10): 946-950. Epub Oct. 4, 2009.

Sanahuja, et al. "Bacillus thuringiensis: a century of research, development and commercial applications." Plant Biotechnol J. Apr. 2011;9(3):283-300. doi: 10.1111/j.1467-7652.2011.00595.x.

Sandoval, et al. Strategy for directing combinatorial genome engineering in *Escherichia coli*. Proc Natl Acad Sci USA. Jun. 26, 2012; 109(26):10540-5.

Sanjuan and Olivares, "Multicopy plasmids carrying the Klebsiella pneumoniae nifA gene enhance Rhizobium meliloti nodulation competitiveness on alfalfa," Molecular Plant-Microbe Interactions, 1991, 4(4):365-369.

Santi et al., Biological nitrogen fixation in non-legume plants. Annals of Botany 2013; 111: 743-767.

Sanyal, A. J., et al., "The Etiology of Hepatocellular Carcinoma and Consequences for Treatment," The Oncologist 2010, 15(Suppl 4):14-22, doi: 10.1634/theoncologist.2010-S4-14.

Schmidt, O., et al., "A Simple Urea Leaf-Feeding Method for the Production of 13C and 15N Labelled Plant Material," Plant and Soil 2001, vol. 229, pp. 197-202.

Schmidt-Dannert et al., Molecular breeding of carotenoid biosynthetic pathways. Nat. Biotechnol. 18:750-753 (2000).

Schmitz, et al. Iron is required to relieve inhibitory effects on NifL on transcriptional activation by NifA in Klebsiella pneumoniae. J Bacteriol. Aug. 1996; 178(15): 4679-4687.

Schouten, et al., Do cisgenic plants warrant less stringent oversight? Nature Biotechnology vol. 24, No. 7, Jul. 2006, p. 753.

Schreier, et al., "Bacillus subtilis glnR mutants defective in regulation", Gene, vol. 161, No. 1., pp. 51-56 (1995).

Schreier, H. J., et al., "Altered Regulation of the glnA Gene in Glutamine Synthetase Mutants of Bacillus subtilis," Journal of Bacteriology, Jul. 1986, vol. 167, No. 1, pp. 35-43.

Schuler, et al., "Insect-resistant transgenic plants," Trends Biotechnol., Apr. 1998, vol. 16, pp. 168-175.

Schuler, et al. "Potential side effects of insect-resistant transgenic plants on arthropod natural enemies." Trends Biotechnol. May 1999;17(5):210-6. doi: 10.1016/S0167-7799(98)01298-0.

Science Council of Japan, New breeding technology in plants (NPBT: New Plant Breeding Techniques) current situation and issues, Aug. 26, 2014, retrieved Nov. 2, 2023, retrieved from URL https://www.scj.go.jp/ja/info/kohyo/pdf/kohyo-22-h140826.pdf, 82 pages.

Search Report, dated Nov. 4, 2020, for Chinese Patent Application No. 201680064863.2 (2 total pages).

Service, R. Genetically engineered microbes make their own fertilizer, could feed the world's poorest. Science Apr. 2017, 2 pages, doi: 10.1126/science.aal1000.

Setten, L., et al., Engineering Pseudomonas protegens Pf-5 for Nitrogen Fixation and its Application to Improve Plant Growth under Nitrogen-Deficient Conditions, PLOS One, May 2013, vol. 8, No. 5, e63666, 14 pages, doi: 10.1371/journal.pone.0063666, including Correction in PLOS One, published Oct. 30, 2013, 2 pages, https://doi.org/10.1371/annotation/279fe0d7-d9b1-4d05-a45a-5ff00b4606b7.

Shahid, M., et al., "Colonization of Vigna radiata by a halotolerant bacterium Kosakonia sacchari improves the ionic balance, stressor metabolites, antioxidant status and yield under NaCl stress," Applied Soil Ecology 2021, vol. 158, 103809, 14 pages, https://doi.org/10.1016/j.apsoil.2020.103809.

Shamseldin, A., "The Role of Different Genes Involved in Symbiotic Nitrogen Fixation—Review," Global Journal of Biotechnology & Biochemistry 8(4): 84-94, 2013.

Sheety et al., Engineering BioBrick vectors from BioBrick parts, J Biol Eng 2008, 2:5, 12 pages.

Shinjo, R., et al., "Complete Genome Sequence of *Kosakonia sacchari* Strain BO-1, an Endophytic Diazotroph Isolated from a Sweet Potato," Genome Announcements, Sep./Oct. 2016, vol. 4, Issue 5, e00868-16, 2 pages.

Shulse, C. N., et al., "Engineered Root Bacteria Release Plant-Available Phosphate from Phytate," Applied and Environmental Microbiology, Sep. 2019, vol. 85, Issue 18, e01210-19, 11 pages, https://doi.org/10.1128/AEM.01210-19.

Sibold et al., "A nif mutant of Klebsiella pneumoniae fixing nitrogen in the presence of ammonia," FEMS Microbiology Letters 10, pp. 37-41 (1981).

Sibold et al. Constitutive expression of nitrogen fixation (nif) genes of Klebsiella pneumoniae due to a DNA duplication. EMBO J. 1982;1(12):1551-8.

Siddavattam, et al., Regulation of nif Gene expression in Enterobacter agglomerans: Nucleotide sequence of the nifLA operon and influence of temperature and ammonium on its transcription. Molecular and general genetics. Dec. 20, 1995; 249(6): 629-636.

Simon et al., (1996) Perturbation of niff expression in Klebsiella pneumoniae has limited effect on nitrogen fixation. J Bacteriol 178(10):2975-2977.

Singer, M. et al., "Genes and Genomes: A Changing Perspective", University Science Books (1998); Moscow, MIR, vol. 1, pp. 63-64 (with English machine translation), 10 total pages.

Singh, et al. An L-methionine-D,L-sulfoximine-resistant mutant of the cyanobacterium Nostoc muscorum showing inhibitor—resistant ?- glutamyl-transferase, defective glutamine synthetase and producing extracellular ammonia during N2 fixation. FEBS Letters. vol. 154, Issue 1, Apr. 5, 1983, pp. 10-14.

Singh et. al., "Protein Engineering Approaches in the Post-Genomic Era" Current Protein and Peptide Science, 2017, 18, 1-11.

Singh, R. K., et al., "Protein Engineering Approaches in the Post-Genomic Era," Current Protein and Peptide Science, 2018, vol. 19, pp. 5-15.

Sivaraman et al., "Codon choice in genes depends on flanking sequence information—implications for theoretical reverse translation," Nucleic Acids Research, vol. 36, No. 3, e16, pp. 1-8 (2008).

Sleight, S.C., & Sauro, H.M. Randomized BioBrick assembly: a novel DNA assembly method for randomizing and optimizing genetic circuits and metabolic pathways. ACS Synth. Biol., 2013, 2(9):506-518.

Sleight, SC. et al., "Designing and engineering evolutionary robust genetic circuits", Journal of Biological Engineering, 2010, vol. 4, No. 12, pp. 1-20.

Smanski et al., "Engineered *Streptomyces platensis* strains that overproduce antibiotics platensimycin and platencin," Antimicrob. Agents Chemother., 2009, 53:1299-12304.

(56) References Cited

OTHER PUBLICATIONS

Smanski, et al., "Functional optimization of gene clusters by combinatorial design and assembly." Nature Biotechnology, Dec. 2014, vol. 32, No. 12, pp. 1241-1249, including Online Methods 3 pages, doi: 10.1038/nbt.3063. Epub Nov. 24, 2014.

Smanski et al., Synthetic biology to access and expand nature's chemical diversity. Nat Rev Microbial. Mar. 2016;14(3):135-49, doi: 10.1038/nrmicro.2015.24.

Soong, J. L., et al., "Design and Operation of a Continuous 13C and 15N Labeling Chamber for Uniform or Differential, Metabolic and Structural, Plant Isotope Labeling," Journal of Visualized Experiments, Jan. 2014, 83, e51117, pp. 1-8, DOI: 10.3791/51117.

Sorek and Cossart, Prokaryotic transcriptomics: a new view on regulation, physiology, and pathogenicity. Nat. Rev. Genet. 11:9-16 (2010).

Souza et al., "The N-Terminus of the NIFA protein of herbaspirillum seropedicae is probably involved in sensing of ammonia." In Tikhonovich et al. (Eds.) Proceedings of the 10th International Congress on Nitrogen Fixation, St. Petersburg, Russia, May 28-Jun. 3, 1995 (p. 260) Dordrecht: Kluwer.

Spiller et al. Isolation and characterization of nitrogenase-derepressed mutant strains of cyanobacterium *Anabaena variabilis.* J Bacterial. Feb. 1986, 165(2):412-419.

Staron et al., "The Third Pillar of Bacterial Signal Transduction: Classification of the Extracytoplasmic Function (ECF) Sigma Factor Protein Family," Mol Microbiol 14(3): 557-81 (2009).

Steenhoudt et al., "Azospirillum, a free-living nitrogen-fixing bacterium closely associated with grasses: genetic, biochemical and ecological aspects." FEMS Microbial. Rev. 2000; 24:487-506.

Stein et al. The osteocalcin gene: a model for multiple parameters of skeletal-specific transcriptional control. Mol Biol Rep. Aug. 1997;24(3):185-96.

Stemmer, "DNA shuffling by random fragmentation and reassembly: in vitro recombination for molecular evolution." Proc Natl Acad Sci U S A. Oct. 25, 1994;91(22):10747-51. doi: 10.1073/pnas. 91.22.10747.

Stemple, "TILLING—a high-throughput harvest for functional genomics." Nat Rev Genet. Feb. 2004;5(2):145-50. doi: 10.1038/nrg1273.

Stephanopoulos, G., "Challenges in engineering microbes for biofuels production," Science. Feb. 9, 2007;315(5813):801-4.

Stewart et al., (1967) In situ studies on nitrogen fixation with the acetylene reduction technique. Science, vol. 158(3800), p. 536.

Streicher, S. L., et al., "Genetic Control of Glutamine Synthetase in Klebsiella aerogenes," Journal of Bacteriology, Jan. 1975, vol. 121, No. 1, pp. 320-331.

Stucken, K., et al. The smallest known genomes of multicellular and toxic cyanobacteria: comparison, minimal gene sets for linked traits and the evolutionary implications. PLoS ONE, Feb. 2010, vol. 5, Issue 2, e9235, pp. 1-15.

Subtil, et al. Secretion of Predicted Inc Proteins of Chlamydia pneumoniae by a Heterologous Type III Machinery. Molecular Microbiology. Feb. 2001, vol. 39, No. 3; pp. 792-800.

Suh, et al., Functional expression of the FeMo-cofactor-specific biosynthetic genes nifEN as a NifE-N fusion protein synthesizing unit in Azotobacter vinelandii. Biochem. Biophys. Res. Comm. 299:233-240 (2002).

Sun, J., et al., "Metabolic peculiarities of Aspergillus niger disclosed by comparative metabolic genomics," Genome Biology 2007, 8: R182, pp. R182.1-R182.13, published Sep. 4, 2007, doi:10.1186/GB-2007-8-9-r182.

Suzuki, S, et al., "Immune-mediated motor polyneuropathy after hematopoietic stem cell transplantation," Bone Marrow Transplantation 2007, vol. 40, pp. 289-291, published online May 14, 2007, doi: 10.1038/sj.bmt.1705716.

Swain et al., "Nitrogen fixation and its improvement through genetic engineering." J. Global Biosciences, 2013, 2(5): 98-112.

Tamsir, A et al., "Robust multicellular computing using genetically encoded NOR gates and chemical 'wires", Nature, 2011, vol. 469, No. 7329, pp. 212-215, 9 pages, doi:10.1038/nature09565.

Tan C, "A synthetic biology challenge: making cells compute," Mol Biosyst 3: 343-353 (2007).

Tang, H., et al., "Biology of Nitrogen-fixing Organisms", Northeast Forestry University Press, First Edition, Jun. 2009, pp. 172-183, with English translation, 26 pages.

Temme et al., Modular control of multiple pathways using engineered orthogonal T7 polymerases. Nucleic Acids Res. 2012, vol. 40(17):8773-8781, Epub Jun. 28, 2012.

Temme et al., "Refactoring the nitrogen fixation gene cluster from Klebsiella oxytoca," Proc. Natl. Acad. Sci. USA, May 2012, 109(18):7085-7090.

Temme K, et al. "Induction and relaxation dynamics of the regulatory network controlling the type III secretion system encoded within *Salmonella* Pathogenicity Island 1," J Mol Biol 2008, 377(1):47-61, 27 pages.

Temme K. L., "Designing and Engineering Complex Behavior in Living Machines", University of California, San Francisco Dissertation. Doctor of Philosophy in Bioengineering, Electronic Thesis and Dissertation, (Oct. 1, 2011), URL: https://escholarship.org/uc/item/1r41x99s.pdf, (Nov. 28, 2014), 75 pages.

Terpolilli, J. J. et al., "What Determines the Efficiency of N2-Fixing Rhizobium-Legume Symbioses?," Advances in Microbial Physiology 2012, vol. 60, pp. 325-389, DOI: 10.1016/B978-0-12-398264-3.00005-X.

Thiel, T., et al., Characterization of genes for a second Mo-dependent nitrogenase in the cyanobacterium Anabaena variabilis. J. Bact. 179:5222-5225 (1997).

Thomas, et al. Ammonium Excretion by an L-Methionine-DL-Sulfoximine-Resistant Mutant of the Rice Field Cyanobacterium *Anabaena siamensis.* Appl Environ Microbiol. Nov. 1990; 56(11):3499-3504.

Tian, H., et al., "Six New Families of Aerobic Arsenate Reducing Bacteria: Leclercia, Raoultella, Kosakonia, Lelliottia, Yokenella, and Kluyvera," Geomicrobiology Journal 2019, vol. 36, No. 4, 339-347, https://doi.org/10.1080/01490451.2018.1554726.

Tijssen, P., "Overview of principles of hybridization and the strategy of nucleic acid probe assay," Part 1, Chapter 2, Hybridization with Nucleic Acid Probes, Laboratory Techniques in Biochemistry and Molecular Biology, Department for Physiological Chemistry, University of Utrecht, Utrecht, The Netherlands, vol. 24 (1993) 65 pages.

Tilman, et al. "Global food demand and the sustainable intensification of agriculture." PNAS 108:20260-20264 (2011).

Travis, B. A., et al., "Molecular dissection of the glutamine synthetase-GlnR nitrogen regulatory circuitry in Gram-positive bacteria," Nature Communications 2022, 13:3793, 15 pages, https://doi.org/10.1038.s41467-022-31573-0.

Triplett, E.W. Diazotrophic endophytes: progress and prospects for nitrogen fixation in monocots. Plant and Soil 1996; 186: 29-38.

Tritt, et al., "An Integrated Pipeline for de Novo Assembly of Microbial Genomes". Sep. 13, 2012. PLOS one. https://doi.org/10.1371/journal.pone.0042304. 9 pages.

Troisfontaines, P., et al., "Type III Secretion: More Systems Than You Think," Physiology, vol. 20, Oct. 2005, pp. 326-339, doi: 10.1152/physiol.00011.2005.

Tyler, H. L. et al., "Plants as a habitat for Beneficial and/or Human Pathogenic Bacteria," Annu. Rev. Phytopathol. 2008, 46:53-73, doi: 10/1146/annurev.phyto.011708.103102 (23 total pages).

Ueda et al., Remarkable N2-Fixing Bacterial Diversity Detected in Rice Roots by Molecular Evolutionary Analysis of nifH Gene Sequences. Journal of Bacteriology, Mar. 1995, p. 1414-1417.

Uozumi, T., et al., "Cloning and Expression of the nif A Gene of Klebsiella oxytoca in K. pneumoniae and Azospirillum lipoferum", Agricultural and Biological Chemistry, 1986, 50(6):1539-1544.

Van Dongen, S., "Performance criteria for graph clustering and Markov cluster experiments," CWI, 2000, 36 pages.

Van Heeswijk et al. "Nitrogen Assimilation in *Escherichia coli*: Putting Molecular Data into a Systems Perspective," Microbiology and Molecular Biology Reviews 2013, vol. 77 No. 4, p. 628-695, doi: 10.1128/MMBR.00025-13.

Venkateshwaran, M., Exploring the feasilibty of transferring nitrogen fixation to cereal crops, Chapter 42, Principles of plant-microbe interactions, Springer, Cham, 403-410 (2015).

(56) References Cited

OTHER PUBLICATIONS

Vernon, et al., "Analysis of 16S rRNA gene sequences and circulating cell-free DNA from plasma of chronic fatigue syndrome and non-fatigued subjects". BMC Microbiology 2002; 2:39. pp. 1-6.

Vick, J. E., et al., "Optimized compatible set of BioBrickTM vectors for metabolic pathway engineering," Appl Microbiol Biotechnol (2011), 92:1275-1286, DOI 10.1007/s00253-011-3633-4.

Villa et al., Azotobacter vinelandii siderophore can provide nitrogen to support the culture of the green algae neochloris oleoabundans and scenedesmus. FEMS Microbial. Lett. 2014; 351(1): 70-77.

Villalobos, A. et al. "Gene Designer: a synthetic biology tool for constructing artificial DNA segments", BMC Bioinformatics, 2006, vol. 7:285, pp. 1-8, doi: 10.1186/1471-2105-7-285.

Voigt, C. A., "Gaining Access: Rebuilding Genetics from the Ground Up", Institute of Medicine Board on Global Health Forum on Microbial Threats, Mar. 2011, 20 pages.

Voigt et al, "Genetic parts to program bacteria", Current Opinion in Biotechnology, 2006, vol. 17, pp. 548-557, doi: 10.1016/J.COPBIO. 2006.09.001.

Wagh, J., et al., "Heterologous expression of pyrroloquinoline quinone (pqq) gene cluster confers mineral phosphate solubilization ability to Herbaspirillum seropedicae Z67," Applied Microbiology and Biotechnology (2014), 98:5117-5129, DOI 10.1007/s00253-014-5610-1.

Wang, C., et al., "*Kosakonia quasisacchari* sp. nov. recovered from human wound secretion in China," International Journal of Systemic and Evolutionary Microbiology, 2019, 69:3155-3160, DOI 10.1099/ijsem.0.003606.

Wang, C., et al., "Roles of poly-3-hydroxybutyrate (PHB) and glycogen in symbiosis of Sinorhizobium meliloti with *Medicago* sp.," Microbiology (2007), 153, pp. 388-398, DOI: 10.1099/mic.0. 29214-0.

Wang, D. et al., "Biofilm formation enables free-living nitrogen-fixing rhizobacteria to fix nitrogen under aerobic conditions," The ISME Journal 2017, vol. 11, No. 7, pp. 1602-1613, published online Mar. 24, 2017, doi: 10.1038/ismej.2017.30.

Wang et al. Ligand-inducible and liver-specific target gene expression in transgenic mice. Nat Biotechnol. Mar. 1997; 15(3):239-43.

Wang et al., Positive and negative regulation of gene expression in eukaryotic cells with an inducible transcriptional regulator. Gene Ther., 4.5 (May 1997): 432-441.

Wang, et al., "Programming cells by multiplex genome engineering and accelerated evolution". Nature (Aug. 13, 2009); 460(7257): 894-898. Epub Jul. 26, 2009, 14 pages.

Wang et al., Using Synthetic biology to distinguish and overcome regulatory and functional barriers related to nitrogen fixation. PLoS One. 2013;8(7):e68677. 11 pages.

Wang, L., et al., "A minimal nitrogen fixation gene cluster from *paenibacillus* sp. WLY78 enables expression of active nitrogenase in *Escherichia coli*," PLoS Genetics, Oct. 2013; 9(10), e1003865, pp. 1-11, DOI: 10.1371/journal.pgen.1003865.

Wang, P., et al., "High Throughput sequencing analysis of bacterial communities in soils of a typical Poyang Lake Wetland," ACTA Ecologica Sinica, vol. 37, No. 5, Mar. 2017, pp. 1-9, DOI: 10.5846/stxb201510052000 (English Abstract).

Wang, T. et al., "Positive and negative regulation of transferred nif genes mediated by indigenous GlnR in Gram-positive Paenibacillus polymyxa," PLoS Genetics, vol. 14, No. 9, e1007629, Sep. 2018, https://doi.org/10.1371/journal.pgen.1007629 (15 total pages).

Wang, W. et al., "Screening, Identification and Growth Promotion Ability of Phosphate Solubilizing Bacteria from Soybean Rhizosphere under Maize-Soybean Intercropping Systems," bioRxiv 2020, 25 pages, doi: https://doi.org/10.1101/2020.12.15.422997.

Wang, X., et al., "Emergence of a novel mobile colistin resistance gene, mcr-8, in NDM-producing Klebsiella pneumoniae," Emerging Microbes & Infections 2018, 7:122, 10 pages, DOI 10.1038/s41426-018-0124-z.

Watanabe et al., (2006) Total biosynthesis of antitumor nonribosomal peptides in *Escherichia coli*. Nature Chemical Biology, 2:423-428.

Watanabe et al., Chapter 15. Plasmid-borne gene cluster assemblage and heterologous biosynthesis of nonribosomal peptides in *Escherichia coli*. Methods Enzymol. 2009;458:379-99. doi:10.1016/S0076-6879(09)04815-0.

Weber, et al., "A Modular Cloning System for Standardized Assembly of Multigene Constructs". PLoS ONE, Feb. 2011, 6(2): e16765, 11 pages, doi: 10.1371/journal.pone.0016765.

Wei, C. et al. "Endophytic nitrogen-fixing *Klebsiella variicola* strain DX120E promotes sugarcane growth", Biol Fertil Soils. 2014. 50:657-666.

Welch et al., "Design Parameters to Control Synthetic Gene Expression in *Escherichia coli*," PLoS One, Sep. 2009, vol. 4, Issue 9, e7002, 10 pages.

Wells, James A, "Additivity of mutational effects in proteins", Biochemistry (1990); 29(37): 8509-8517.

Wen, A., et al., "Enabling Biological Nitrogen Fixation for Cereal Crops in Fertilized Fields," ACS Synth. Biol. 2021, 10, 3264-3277, published Dec. 1, 2021, https://doi.org/10.1021/acssynbio.1c00049.

Wenzel S. C. & Muller R., Recent developments towards the heterologous expression of complex bacterial natural product biosynthetic pathways. Curr Opin Biotechnol 2005, 16(6):594-606.

Werner et al., Fast track assembly of multigene constructs using Golden Gate cloning and the MoClo system. Bioeng Bugs. Jan. 1, 2012 ;3(1):38-43, doi: 10.1371/journal.pone.0016765. Epub Jan. 1, 2012.

Widmaier, et al. Engineering the Salmonella type III secretion system to export spider silk monomers. Mol. Syst. Biol. 5, No. 309, pp. 1-9 (2009), doi:10.1038/msb.2009.62.

Willardson, B. M., et al., "Development and Testing of a Bacterial Biosensor for Toluene-Based Environmental Contaminants," Applied and Environmental Microbiology, Mar. 1998, vol. 64, No. 3, pp. 1006-1012.

Wimpenny, J. et al., "An overview of biofilms as functional communities," Community structure and co-operation in biofilms, 59th Symposium of the Society for General Microbiology, D.G. Allison, P. Gilbert, H.M. Lappin-Scott and M. Wilson, Eds., 2000, 28 pages.

Witkowski, A. et al., "Conversion of a β-Ketoacyl Synthase to a Malonyl Decarboxylase by Replacement of the Active-Site Cysteine with Glutamine," Biochemistry 1999, 38, pp. 11643-11650.

Woolbright, B. L, et al., "Novel insight into mechanisms of cholestatic liver injury," World Journal of Gastroenterology, Sep. 28, 2012, 18(36): 4985-4993, doi: 10.3748/wjg.v18.i36.4985.

Wootton et al. Statistics of local complexity in amino acid sequences and sequence databases. Computers & Chemistry. vol. 17, Issue 2, Jun. 1993, pp. 149-163.

Written Opinion, dated, Jan. 4, 2019, for International Application No. PCT/US2018/057174, 3 pages.

Wu, et al., "Effects of different amendments on contents of phenolic acids and specific microbes in rhizo-sphere of Pseudostellaria heterophylla," Chinese Journal of Applied Ecology, Nov. 2016, 27(11): 3623-3630, DOI: 10.13287/j.1001-9332.201611.004 (English abstract only).

Wu, et al., "Mixed Phenolic Acids Mediated Proliferation of Pathogens Talaromyces helicus and Kosakonia sacchari in Continuously Monocultured Radix pseudostellariae Rhizosphere Soil," Frontiers in Microbiology, Mar. 2016, vol. 7, Article 335, 14 pages, doi: 10.3389/fmicb.2016.00335.

Wu et al., "Root exudates from two tobacco cultivars affect colonization of Ralstonia solanacearum and the disease index," European Journal of Plant Pathology, 2014, 141(4):667-677.

Wu, H., et al., "Insights into the Mechanism of Proliferation on the Special Microbes Mediated by Phenolic Acids in the Radix pseudostellariae Rhizosphere under Continuous Monoculture Regimes," Frontiers in Plant Science, May 2017, vol. 8, Article 659, 15 pages, DOI: 10.3389/fpls.2017.00659.

Wu, H., et al., "The role of organic acids on microbial deterioration in the Radix pseudostellariae rhizosphere under continuous monoculture regimes," Scientific Reports, 7:3497, 13 pages, published online Jun. 14, 2017, doi: 10.1038/s41598-017-03793-8.

Wu, J., et al. Multivariate modular metabolic engineering of *Escherichia coli* to produce resveratrol from L-tyrosine. J. Biotechnol. (2013), 167:404-411.

(56)                References Cited

OTHER PUBLICATIONS

Wu, S. C., et al., "Effects of biofertilizer containing N-fixer, P and K solubilizers and AM fungi on maize growth: a greenhouse trial," Geoderma 125 (2005), pp. 155-166, doi:10.1016/j.geoderma.2004. 07.003.

Xiao, Y., et al., "Developing a Genetically Encoded, Cross-Species Biosensor for Detecting Ammonium and Regulating Biosynthesis of Cyanophycin," ACS Synthetic Biology 2017, 6, 1807-1815, published Jul. 6, 2017, DOI: 10.1021/acssynbio.7b00069.

Xie, Z., et al., "Interaction between NifL and NifA in the nitrogen-fixing Pseudomonas stutzeri A1501," Microbiology (2006), 152, pp. 3535-3542, DOI 10.1099/mic.0.29171-0.

Xu, et al., ePathBrick: a synthetic biology platform for engineering metabolic pathways in E. coli. ACS Synth. Biol., 1:256-266 (2012).

Xu Ye et al., "Advance of Study on Nitrogenase", Journal of Biology, vol. 28, No. 4, Aug. 2011, pp. 61-64 (English abstract only).

Yan, N., et al., "Influence of salinity and water content on soil microorganisms," International Soil and Water Conservation Research 3 (2015), pp. 316-323, https://doi.org/10.1016/j.iswcr.2015.11.003.

Yan, Y., et al., "Global transcriptional analysis of nitrogen fixation and ammonium repression in root-associated Pseudomonas stutzeri A1501," BMC Genomics 2010, 11:11, pp. 1-13, http://www. biomedcentral.com/1471-2164/11/11.

Yao et al., "Complementation analysis of heterologous nifA genes to nifA mutants of Sinorhizobium pallida," Chinese Science Bulletin, Oct. 2006, 51(19):2258-2264, 9 pages (English abstract only).

Yarza et al., "Uniting the classification of cultured and uncultured bacteria and archaea using 16S rRNA gene sequences," Nature Rev. Micro. 12:635-645 (2014).

Ye, J., et al., "Primer-BLAST: A tool to design target-specific primers for polymerase chain reaction," BMC Bioinformatics, 2012, 13: 134, 11 pages.

Yokobayashi et al, (2002) Directed evolution of a genetic circuit. Proc Natl Acad Sci USA 99(26):16587-16591.

Yoshida et al., Atmospheric dinitrogen fixation in the flooded rice rhizosphere as determined by the N-15 isotope technique. Soil Science and Plant Nutrition, Dec. 1980, 26(4):551-559.

Young, C. and Pratt-Szeliga, A., Ceres Trust. 2012. https://cerestrust. org/wp-content/uploads/NitrogenFixingBacteriaCorn.pdf, 9 pages.

Yu et al., Recombineering Pseudomonas protegens CHA0: An innovative approach that improves nitrogen fixation with impressive bactericidal potency. Microbial Res. 2019, 218:58-65, available online Oct. 6, 2018, doi: 10.1016/j.micres.2018.09.009.

Yurgel S. N. et al., "A mutant GlnD nitrogen sensor protein leads to a nitrogen-fixing but ineffective Sinorhizobium meliloti symbiosis with alfalfa," PNAS, Dec. 2, 2008, vol. 105, No. 48, pp. 18958-18963, https://doi.org/10.1073/pnas.0808048105.

Zaller, J. G., et al., "Editorial: Non-target Effects of Pesticides on Organisms Inhabiting Agroecosystems," Frontiers in Environmental Science, May 2019, vol. 7, Article 75, pp. 1-3, doi: 10.3389/ fenvs.2019.00075.

Zaslaver et al., (2006) Optimal gene partition into operons correlates with gene functional order. Phys Biol 3(3): 183-189.

Zazopoulos E, et al., "A genomics-guided approach for discovering and expressing cryptic metabolic pathways," Nat Biotechnol 21(2):187-190, Feb. 2003, doi: 10.1038/nbt784.

Zehr, et al. New Nitrogen-Fixing Microorganisms Detected in Oligotrophic Oceans by Amplification of Nitrogenase (nifH) Genes. Appl Environ Microbiol. Sep. 1998; 64(9): 3444-3450.

Zehr lab NifH database, retrieved from URL https://wwwzehr.pmc. ucsc.edu/nifH_Database_Public/, Apr. 4, 2014, 1 page.

Zhang et al., Influence of different factors on the nitrogenase activity of the engineered Escherichia coli 78-7, World Journal of Microbiology and Biotechnology 31, pp. 921-927, published online Apr. 8, 2015, doi: 10.1007/s11274-015-1846-x.

Zhang et al., "Mutagenesis and functional characterization of the four domains of GlnD, a bifunctional nitrogen sensor protein," Journal of Bacteriology, Jun. 2010, 192(11):2711-2721.

Zhang et. al., "Propagated Perturbations from a Peripheral Mutation Show Interactions Supporting WW Domain Thermostability" Structure 26, 2018.1474-1485.

Zhang, L., et al., "Expression of the N2 fixation gene operon of Paenibacillus sp. WLY78 under the control of the T7 promoter in Escherichia coli BL21," Biotechnol Lett., 2015, 37: 1999-2004, epub Jun. 9, 2015, DOI: 10.1007/s10529-015-1874-5.

Zhang, T., et al., "Involvement of the ammonium transporter AmtB in nitrogenase regulation and ammonium excretion in Pseudomonas stutzeri A1501," Research in Microbiology 163 (2012), pp. 332-339, doi: 10.1016/j.resmic.2012.05.002.

Zhang, Y., et al., "GlnD Is Essential for NifA Activation, NtrB/ NtrC-Regulated Gene Expression, and Posttranslational Regulation of Nitrogenase Activity in the Photosynthetic, Nitrogen-Fixing Bacterium Rhodospirillum rubrum," Journal of Bacteriology, Feb. 2005, 187(4), pp. 1254-1265, doi: 10.1128/JB.187.4.1254-1265. 2005.

Zhang, Y., et al., "Mutagenesis and Functional Characterization of the glnB, glnA, and nifA Genes from the Photosynthetic Bacterium Rhodospirillum rubrum," Journal of Bacteriology, Feb. 2000, vol. 182, No. 4, pp. 983-992.

Zhao et al., "Evidence for nifU and nifS participation in the biosynthesis of the iron-molybdenum cofactor of nitrogenase," J. Biol. Chem., 2007, 282(51):37016-37025.

Zhao, Z., et al., "Soil bacterial community composition in rice-fish integrated farming systems with different planting years," Scientific Reports (2021), 11:10855, pp. 1-10, https://doi.org/10.1038/s41598-021-90370-9.

Zhu, B., et al., "Enterobacter sacchari sp. nov., a nitrogen-fixing bacterium associated with sugar cane (Saccharum officinarum L.)," International Journal of Systemic and Evolutionary Microbiology (2013), 63, 2577-2582, DOI 10.1099/ijs.0.045500-0.

Zhu, B., et al., "Genome Sequence of Enterobacter sp. Strain SP1, an Endophytic Nitrogen-Fixing Bacterium Isolated from Sugarcane," J. Bacterial., Dec. 2012, vol. 194, No. 24, pp. 6963-6964, doi: 10.1128/JB.01933-12.

Zomer, A. L. (2011) PPP: Perform Promoter Prediction, retrieved from URL web.archive.org/web/20141018000631/ http://bioinformatics. biol.rug.nl/websoftware/ppp/ppp_start.php, 2 pages.

Zou, XiaoXiao, et al., "Identification and functional characterization of NifA variants that are independent of GlnB activation in the photosynthetic bacterium Rhodospirillum rubrum," Microbiolody, Sep. 2008, vol. 154, No. 9, pp. 2689-2699, doi: 10.1099/mic.0. 2008/019406-0.

Ayres Sia, E., et al., "Different Relative Importances of the par Operons and the Effect of Conjugal Transfer on the Maintenance of Intact Promiscuous Plasmid RK2," Journal of Bacteriology, May 1995, vol. 177, No. 10, pp. 2789-2797.

Final Office Action, dated Feb. 25, 2025, for U.S. Appl. No. 17/278,022, 33 pages.

Hearing adjournment notice, dated Feb. 25, 2025, for Indian Patent Application No. 201917031229, 3 pages.

Non-Final Office Action, dated Apr. 4, 2025, for U.S. Appl. No. 18/345,783, 58 pages.

Non-Final Office Action, dated Apr. 23, 2025, for U.S. Appl. No. 17/822,740, 15 pages.

Notice of Acceptance, dated Apr. 8, 2025, for Australian Patent Application No. 2018354221, 3 pages.

Notice of Allowance, dated Mar. 25, 2025, for Canadian Patent Application No. 3,080,172, 1 page.

Notice of Allowance, dated Apr. 30, 2025, for Mexican Patent Application No. MX/a/2020/014295, 8 pages.

Office Action for Australian Patent Application No. 2020261427, dated Mar. 7, 2025, 6 pages.

Office Action for Brazilian Patent Application No. BR122024009210-7 dated Mar. 11, 2025, with English translation, 17 pages.

Office Action, dated Mar. 27, 2025, for Chinese Patent Application No. 202210708554.1, with English translation, 14 pages.

Office Action for European Patent Application No. 19826654.6 dated Jun. 24, 2025, 7 pages.

Office Action, dated Apr. 3, 2025, for Mexican Patent Application No. MX/a/2021/012909, with English translation, 11 pages.

(56)                       References Cited

OTHER PUBLICATIONS

Office Action, dated Feb. 4, 2025, for Japanese Patent Application No. 2023- 171070, with English translation, 8 pages.
Office Action, dated Mar. 26, 2025, for Mexican Patent Application No. MX/a/2021/003306, 12 pages.
Pan, L., et al., "Phosphate-Solubilizing Bacteria: Advances in Their Physiology, Molecular Mechanisms, and Microbiology Community Effects," Microorganisms 2023, 11, 2904, published Dec. 1, 2023, pp. 1-22, https://doi.org/10.3390/microorganisms11122904.
Rodriguez, H., et al., "Phosphate solubilizing bacteria and their role in plant growth promotion," Biotechnology advances 1999, 17, 319-339.

* cited by examiner

Guided Microbial Remodeling - An Overview

Map Metabolism and Link to Genetics

Measure
Microbiome Composition

Identify Species
of Interest

Introduce Targeted Non-intergeneric Genomic Alterations

1. Conjugation and Recombination
2. Chemical Mutagenesis
3. Adaptive Evolution
4. Gene Editing Inoculate Crops with Derivative Remodeled Microbes Rapid Uptake Depletes The Pool Of Crop-Available Nitrogen Metrics for Success of an N Biofertilizer for Corn

- Release of fixed N from microbe

- Transfer of fixed N to host plant

- Overcome N deficiency

- Robustly colonize corn in the field

- Express nitrogenase (*nifH*) in the presence of fertilizer

Example: remodeling strain PBC6.1

*nif* gene cluster
encoding nitrogenase
biosynthesis genes

Colonizes corn roots
in greenhouse and field

PBC6.1 expressing RFP
localized on corn rhizoplane

Complex regulation
of nitrogen metabolism

Improve The Assimilation And Excretion Of Fixed Nitrogen

Nitrogen Runoff and GHG Emissions massive environmental impact

Up to 40% of Acres Are Over Fertilized unnecessary fertilizer expense

Many Fields Are Under Fertilized unrealized yield potential

FIG. 5A
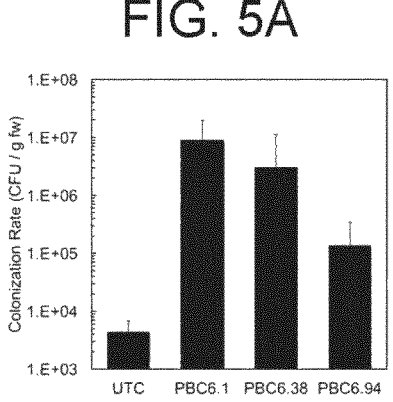
FIG. 5B
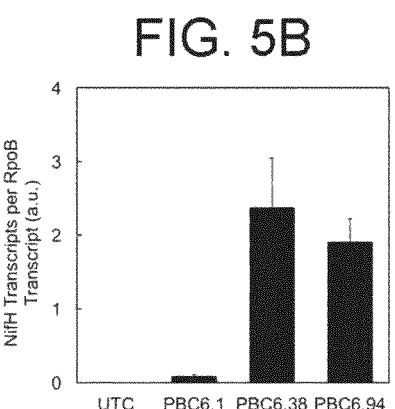
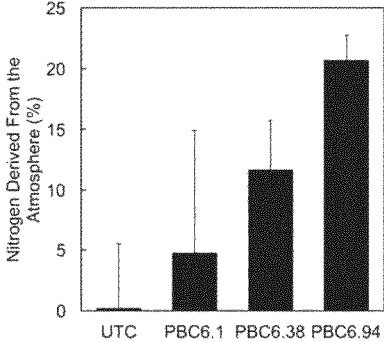
FIG. 5C

| Strain Name | Activity (mmol N / Microbe hr) | Peak Colonization (CFU / g fw) |
|---|---|---|
| CI006 | 4.45E-16 | 2.55E+05 |
| CM038 | 3.26E-13 | 7.39E+05 |
| CM014 | 2.72E-13 | 7.39E+05 |
| CM093 | 4.27E-13 | 7.39E+05 |
| CM094 | 5.49E-13 | 7.39E+05 |
| CM029 | 2.95E-13 | 7.39E+05 |
| CI019 | 4.32E-17 | 2.89E+07 |
| CM011 | 2.95E-15 | 3.49E+07 |
| CM067 | 2.30E-17 | 3.49E+07 |
| CM069 | 3.10E-17 | 3.49E+07 |
| CM081 | 8.63E-16 | 3.49E+07 |
| 19-715 | 1.28E-15 | 3.49E+07 |
| 19-714 | 1.57E-15 | 3.49E+07 |
| 19-594 | 3.31E-15 | 3.49E+07 |
| 19-590 | 1.14E-14 | 3.49E+07 |
| 19-713 | 1.96E-14 | 3.49E+07 |
| 19-724 | 2.41E-14 | 3.49E+07 |
| CI911 | 3.48E-17 | 1.24E+07 |
| CI730 | 5.64E-17 | 2.89E+07 |

Nutrient Stress

Sufficient Fertilizer 910                                              1246

63                                          1146

GUIDED MICROBIAL REMODELING, A PLATFORM FOR THE RATIONAL IMPROVEMENT OF MICROBIAL SPECIES FOR AGRICULTURE

CROSS-REFERENCE TO RELATED APPLICATIONS

The present application is a continuation of U.S. patent application Ser. No. 17/255,304 filed Dec. 22, 2020, which claims the benefit of International PCT Application No. PCT/US2019/039528, filed Jun. 27, 2019, which claims the benefit of priority to U.S. Provisional Application No. 62/690,619, filed on Jun. 27, 2018, which is incorporated by reference herein in its entirety.

INCORPORATION BY REFERENCE OF THE SEQUENCE LISTING

The contents of the electronic sequence listing (PIVO_007_02US_SeqList_ST26.xml; Size: 1,045,524 bytes; and Date of Creation: Mar. 8, 2024) are herein incorporated by reference in its entirety.

BACKGROUND OF THE DISCLOSURE

By 2050 the United Nations' Food and Agriculture Organization projects that total food production must increase by 70% to meet the needs of a growing population, a challenge that is exacerbated by numerous factors, including: diminishing freshwater resources, increasing competition for arable land, rising energy prices, increasing input costs, and the likely need for crops to adapt to the pressures of a drier, hotter, and more extreme global climate.

Current agricultural practices are not well equipped to meet this growing demand for food production, while simultaneously balancing the environmental impacts that result from increased agricultural intensity.

One of the major agricultural inputs needed to satisfy global food demand is nitrogen fertilizer. However, the current industrial standard utilized to produce nitrogen fertilizer, is an artificial nitrogen fixation method called the Haber-Bosch process, which converts atmospheric nitrogen ($N_2$) to ammonia ($NH_3$) by a reaction with hydrogen ($H_2$) using a metal catalyst under high temperatures and pressures. This process is resource intensive and deleterious to the environment.

In contrast to the synthetic Haber-Bosch process, certain biological systems have evolved to fix atmospheric nitrogen. These systems utilize an enzyme called nitrogenase that catalyzes the reaction between $N_2$ and $H_2$, and results in nitrogen fixation. For example, rhizobia are diazotrophic bacteria that fix nitrogen after becoming established inside root nodules of legumes. An important goal of nitrogen fixation research is the extension of this phenotype to non-leguminous plants, particularly to important agronomic grasses such as wheat, rice, and corn. However, despite the significant progress made in understanding the development of the nitrogen-fixing symbiosis between rhizobia and legumes, the path to use that knowledge to induce nitrogen-fixing nodules on non-leguminous crops is still not clear.

Consequently, the vast majority of modern row crop agriculture utilizes nitrogen fertilizer that is produced via the resource intensive and environmentally deleterious Haber-Bosch process. For instance, the USDA indicates that the average U.S. corn farmer typically applies between 130 and 200 lb. of nitrogen per acre (146 to 224 kg/ha). This nitrogen is not only produced in a resource intensive synthetic process, but is applied by heavy machinery crossing/impacting the field's soil, burning petroleum, and requiring hours of human labor.

Furthermore, the nitrogen fertilizer produced by the industrial Haber-Bosch process is not well utilized by the target crop. Rain, runoff, heat, volatilization, and the soil microbiome degrade the applied chemical fertilizer. This equates to not only wasted money, but also adds to increased pollution instead of harvested yield. To this end, the United Nations has calculated that nearly 80% of fertilizer is lost before a crop can utilize it. Consequently, modern agricultural fertilizer production and delivery is not only deleterious to the environment, but it is extremely inefficient.

In order to meet the world's growing food supply needs—while also balancing resource utilization and providing minimal impacts upon environmental systems—a better approach to nitrogen fixation and delivery to plants is urgently needed.

SUMMARY OF THE DISCLOSURE

Provided herein are guided microbial remodeling (GMR) methods for the rational improvement of plant-associated microbes to perform plant-beneficial functions.

In one aspect, the GMR method comprises: (a) providing a plurality of microbial species that are associated with a target plant of interest; (b) assaying the plurality of microbial species for: colonization metrics, and ability to perform a plant-beneficial function of interest; (c) selecting a candidate microbial species from the plurality of assayed microbial species; (d) introducing one or more targeted non-intergeneric genetic variations into the candidate microbial species; (e) confirming integration of the non-intergeneric genetic variation at the target genomic locus and absence of any transgenetic sequence; and (f) repeating steps d) and e) one or more times, until the candidate microbial species has acquired an improved ability to perform the plant-beneficial function of interest.

In one aspect, the step b) of assaying the plurality of microbial species comprises assaying the plurality of microbial species for transcriptionally active genes under metabolically relevant environmental conditions.

In one aspect, the GMR method comprises a step of sequencing the genomes of the plurality of microbial species obtained in step a) and characterizing one or more genomic pathways, or sets of genes, that are associated with a plant-beneficial function of interest.

In one aspect, the step d) of introducing one or more targeted non-intergeneric genetic variations into the candidate microbial species comprises: (a) transforming the candidate microbial species with a transformation plasmid comprising (i) a selection marker, (ii) a counterselection marker, (iii) a DNA fragment comprising: a non-intergeneric genetic variation to be introduced into the candidate microbial species at a target genomic locus in one or more genomic pathways, or sets of genes, that are associated with a plant-beneficial function of interest, and homology arms to the target genomic locus flanking the non-intergeneric genetic variation, and (iv) plasmid backbone; (b) selecting for a candidate microbial species that has undergone an initial homologous recombination and has the non-intergeneric genetic variation integrated into the target genomic locus based on the presence of the selection marker in the genome; and (c) selecting for a candidate microbial species that has the non-intergeneric genetic variation integrated into the target genomic locus, but has undergone an additional homologous recombination that loops-out the plasmid backbone, based on the absence of the counterselection marker.

In one aspect, the step e) of confirming integration of the non-intergeneric genetic variation at the target genomic locus and absence of any transgenetic sequence comprises sequencing the genome of the transformed candidate microbial species and confirming absence of any transgenetic sequence from the genome of the transformed candidate microbial species. In one aspect, the step e) comprises confirming absence of any transgenetic sequence from the transformation plasmid.

In one aspect, the GMR method comprises: (a) providing a plurality of microbial species that are associated with a target plant of interest; (b) sequencing the genomes of the plurality of microbial species and characterizing one or more genomic pathways, or sets of genes, that are associated with a plant-beneficial function of interest; (c) assaying the plurality of microbial species for: colonization metrics, transcriptionally active genes under metabolically relevant environmental conditions, and ability to perform a plant-beneficial function of interest; (d) selecting a candidate microbial species from the plurality of assayed microbial species; (e) transforming the candidate microbial species with a transformation plasmid comprising: (i) a selection marker, (ii) a counterselection marker, (iii) a DNA fragment comprising: a non-intergeneric genetic variation to be introduced into the candidate microbial species at a target genomic locus in one or more genomic pathways, or sets of genes, that are associated with a plant-beneficial function of interest, and homology arms to the target genomic locus flanking the non-intergeneric genetic variation; and (iv) plasmid backbone; (f) selecting for a candidate microbial species that has undergone an initial homologous recombination and has the non-intergeneric genetic variation integrated into the target genomic locus based on the presence of the selection marker in the genome; (g) selecting for a candidate microbial species that has the non-intergeneric genetic variation integrated into the target genomic locus, but has undergone an additional homologous recombination that loops-out the plasmid backbone, based on the absence of the counterselection marker; (h) sequencing the genome of the transformed candidate microbial species and confirming integration of the non-intergeneric genetic variation at the target genomic locus and absence of any genetic sequence from the transformation plasmid; and (i) repeating steps e)-h) one or more times, until a candidate microbial species has acquired an improved ability to perform the plant-beneficial function of interest.

In one aspect, the plant-beneficial functions of interest in the methods described herein can be nitrogen fixation, phosphate solubilization, microbial colonization, or combinations thereof.

In one aspect, the step of sequencing the genomes of the plurality of microbial species and characterizing one or more genomic pathways, or sets of genes, that are associated with a plant-beneficial function of interest (e.g. step b of the method described above) comprises whole genome sequencing and/or characterizing the nitrogen fixation pathway.

In one aspect, characterizing the nitrogen fixation pathway comprises characterizing a set of genes selected from the group consisting of: nifA, nifL, ntrB, ntrC, polynucleotide encoding glutamine synthetase, glnA, glnB, glnK, drat, amtB, polynucleotide encoding glutaminase, glnD, glnE, nifJ, nifH, nifD, nifK, nifY, nifE, nifN, nifU, nifS, nifV, nifW, nifZ, nifM, nifF, nifB, nifQ, a gene associated with biosynthesis of a nitrogenase enzyme, and combinations thereof.

In one aspect, characterizing the microbial colonization pathway comprises characterizing one or more genes involved in a pathway selected from the group consisting of: exopolysaccharide production, endo-polygalaturonase production, trehalose production, and glutamine conversion.

In one aspect, characterizing the microbial colonization pathway comprises characterizing one or more genes selected from the group consisting of: bcsii, bcsiii, yjbE, fhaB, pehA, otsB, treZ, glsA2, and combinations thereof.

In one aspect, characterizing the microbial colonization pathway comprises characterizing one or more genes selected from the group consisting of: nifA, nifL, ntrB, ntrC, polynucleotide encoding glutamine synthetase, glnA, glnB, glnK, drat, amtB, polynucleotide encoding glutaminase, glnD, glnE, nifJ, nifH, nifD, nifK, nifY, nifE, nifN, nifU, nifS, nifV, nifW, nifZ, nifM, nifF, nifB, nifQ, a gene associated with biosynthesis of a nitrogenase enzyme, bcsii, bcsiii, yjbE, fhaB, pehA, otsB, treZ, glsA2, and combinations thereof.

In one aspect, the step of assaying the plurality of microbial species for colonization metrics (e.g. in step c of the method described above) comprises assaying the plurality of microbial species for colonization metrics under greenhouse or lab based conditions and/or under field conditions.

In one aspect, the colonization metric comprises at least one of the following: spatial colonization patterns, temporal colonization dynamics, density of colonization, or combinations thereof.

In one aspect, the step of assaying the plurality of microbial species for transcriptionally active genes under metabolically relevant environmental conditions (e.g. in step c of the method described above) occurs under greenhouse or lab based conditions.

In one aspect, the step of assaying the plurality of microbial species for transcriptionally active genes under metabolically relevant environmental conditions (e.g. in step c of the method described above) occurs under field conditions.

In one aspect, the step of assaying the plurality of microbial species for transcriptionally active genes under metabolically relevant environmental conditions (e.g. in step c of the method described above) occurs in vitro.

In one aspect, the step of assaying the plurality of microbial species for transcriptionally active genes under metabolically relevant environmental conditions (e.g. in step c of the method described above) occurs under greenhouse or lab based conditions; under field conditions; and/or in vitro.

In one aspect, the step of assaying the plurality of microbial species for transcriptionally active genes under metabolically relevant environmental conditions (e.g. in step c of the method described above) occurs under greenhouse or lab based conditions and comprises (i) measuring the transcriptomic profile of the microbial species; (ii) measuring the transcriptomic activity of genes associated with the microbial species' ability to perform a plant-beneficial function of interest; (iii) measuring the transcriptomic activity of regulatory gene sequences; (iv) measuring the transcriptomic activity of promoter sequences; (v) measuring the transcriptomic activity of promoter sequences in the presence of exogenous nitrogen; and/or (vi) measuring the transcriptomic activity of promoter sequences in the presence of exogenous nitrogen, wherein said transcriptomic activity of the promoter sequences is measured by quantifying the expression of a regulated gene.

In one aspect, the step of assaying the plurality of microbial species for transcriptionally active genes under metabolically relevant environmental conditions (e.g. in step c of the method described above) occurs under field conditions and comprises (i) measuring the transcriptomic profile of the microbial species; (ii) measuring the transcriptomic activity of genes associated with the microbial species' ability to perform a plant-beneficial function of interest; (iii) measuring the transcriptomic activity of regulatory gene sequences; (iv) measuring the transcriptomic activity of promoter sequences; (v) measuring the transcriptomic activity of promoter sequences in the presence of exogenous nitrogen; and/or (vi) measuring the transcriptomic activity of promoter sequences in the presence of exogenous nitrogen, wherein said transcriptomic activity of the promoter sequences is measured by quantifying the expression of a regulated gene.

In one aspect, the step of assaying the plurality of microbial species for transcriptionally active genes under metabolically relevant environmental conditions (e.g. in step c of the method described above) occurs in vitro and comprises (i) measuring the transcriptomic profile of the microbial species; (ii) measuring the transcriptomic activity of genes associated with the microbial species' ability to perform a plant-beneficial function of interest; (iii) measuring the transcriptomic activity of regulatory gene sequences; (iv) measuring the transcriptomic activity of promoter sequences; (v) measuring the transcriptomic activity of promoter sequences in nitrogen-depleted and nitrogen-replete conditions; and/or (vi) measuring the transcriptomic activity of promoter sequences in nitrogen-depleted and nitrogen-replete conditions, wherein said transcriptomic activity of the promoter sequences is measured by quantifying the expression of a regulated gene.

In one aspect, the step of assaying the plurality of microbial species for colonization metrics (e.g. in step c of the guided microbial remodeling method described above) comprises: growing said plurality of microbial species in intimate association with a target plant.

In one aspect, the step of assaying the plurality of microbial species for colonization metrics (e.g. in step c of the guided microbial remodeling method described above) comprises: growing said plurality of microbial species in intimate association with a target plant under greenhouse or lab based conditions.

In one aspect, the step of assaying the plurality of microbial species for colonization metrics (e.g. in step c of the guided microbial remodeling method described above) comprises: growing said plurality of microbial species in intimate association with a target plant under field conditions.

In one aspect, the step of assaying the plurality of microbial species for colonization metrics (e.g. in step c of the guided microbial remodeling method described above) comprises: growing said plurality of microbial species in intimate association with a target plant under greenhouse or lab based conditions and under field conditions.

In one aspect, the step of assaying the plurality of microbial species for transcriptionally active genes under metabolically relevant environmental conditions (e.g. in step c of the guided microbial remodeling method described above) comprises: growing said plurality of microbial species in intimate association with a target plant.

In one aspect, the step of assaying the plurality of microbial species for transcriptionally active genes under metabolically relevant environmental conditions (e.g. in step c of the guided microbial remodeling method described above)

comprises: growing said plurality of microbial species in intimate association with a target plant under greenhouse or lab based conditions.

In one aspect, the step of assaying the plurality of microbial species for transcriptionally active genes under metabolically relevant environmental conditions (e.g. in step c of the guided microbial remodeling method described above) comprises: growing said plurality of microbial species in intimate association with a target plant under field conditions.

In one aspect, the step of assaying the plurality of microbial species for transcriptionally active genes under metabolically relevant environmental conditions (e.g. in step c of the guided microbial remodeling method described above) comprises: growing said plurality of microbial species in intimate association with a target plant under greenhouse or lab based conditions and under field conditions.

In one aspect, the step of assaying the plurality of microbial species for colonization metrics and transcriptionally active genes under metabolically relevant environmental conditions (e.g. in step c of the guided microbial remodeling method described above) comprises: growing said plurality of microbial species in intimate association with a target plant under field conditions.

In one aspect, the step of assaying the plurality of microbial species in step c of the guided microbial remodeling method described above comprises assaying the plurality of microbial species for ability to perform a plant-beneficial function of interest under greenhouse or lab based conditions.

In one aspect, the step of assaying the plurality of microbial species in step c of the guided microbial remodeling method described above comprises assaying the plurality of microbial species for nitrogen fixation activity. In one aspect, the nitrogen fixation activity is assayed in an acetylene reduction assay or ammonium excretion assay.

In one aspect, the transformation plasmid used in step e of the guided microbial remodeling method described above is a suicide plasmid.

In one aspect, sequencing the genome of the transformed candidate microbial species and confirming integration of the non-intergeneric genetic variation at the target genomic locus and absence of any genetic sequence from the transformation plasmid (step h of the guided microbial remodeling method described above) comprises whole genome sequencing.

In one aspect, provided herein is a guided microbial remodeling method for the rational improvement of plant-associated microbes to perform plant-beneficial functions, comprising: (a) providing a plurality of microbial species; (b) assaying the plurality of microbial species for: colonization metrics, and ability to perform a plant-beneficial function of interest; (c) selecting a candidate microbial species from the plurality of assayed microbial species; (d) introducing one or more targeted non-intergeneric genetic variations into the candidate microbial species at a target genomic locus in one or more genomic pathways, or sets of genes, that are associated with a plant-beneficial function of interest; (e) confirming integration of the non-intergeneric genetic variation at the target genomic locus and absence of any transgenic genetic sequence; and (f) repeating steps d)-e) one or more times, until a candidate microbial species has acquired an improved ability to perform the plant-beneficial function of interest. In a further aspect of this embodiment, the step b) comprises assaying transcriptionally active genes under metabolically relevant environmental conditions. In a further aspect of this embodiment, in step d), said non-intergeneric genetic variations are selected from the group consisting of: full gene deletions, partial gene deletions, promoter insertions, single base pair changes, and combinations thereof. In yet further aspect of this embodiment, step e) comprises sequencing the genome of the candidate microbial species.

In one aspect, provided herein is A guided microbial remodeling method for the rational improvement of plant-associated microbes to perform plant-beneficial functions, comprising: (a) providing a plurality of microbial species; (b) assaying the plurality of microbial species for: colonization metrics, and ability to perform a plant-beneficial function of interest; (c) selecting a candidate microbial species from the plurality of assayed microbial species; (d) introducing two or more targeted non-intergeneric genetic variations into the candidate microbial species at two or more target genomic loci, in one or more genomic pathways, or sets of genes, that are associated with a plant-beneficial function of interest; and (e) confirming introduction of the non-intergeneric genetic variations at the target genomic loci and absence of any transgenic genetic sequence. In a further aspect of this embodiment, step b) comprises assaying transcriptionally active genes under metabolically relevant environmental conditions. In a further aspect of this embodiment, in step d), said non-intergeneric genetic variations are selected from the group consisting of: full gene deletions, partial gene deletions, promoter insertions, single base pair changes, and combinations thereof. In a further aspect of this embodiment, step e) comprises sequencing the genome of the candidate microbial species.

In one aspect, provided herein is a guided microbial remodeling method for the rational improvement of plant-associated microbes to perform plant-beneficial functions, comprising: (a) providing a plurality of microbial species; (b) assaying the plurality of microbial species for: colonization metrics, transcriptionally active genes under metabolically relevant environmental conditions, and ability to perform a plant-beneficial function of interest; (c) selecting a candidate microbial species from the plurality of assayed microbial species; (d) introducing one or more targeted non-intergeneric genetic variations into the candidate microbial species at a target genomic locus in one or more genomic pathways, or sets of genes, that are associated with a plant-beneficial function of interest, said non-intergeneric genetic variations selected from the group consisting of: full gene deletions, partial gene deletions, promoter insertions, single base pair changes, and combinations thereof; (e) sequencing the genome of the candidate microbial species and confirming integration of the non-intergeneric genetic variation at the target genomic locus and absence of any transgenic genetic sequence; and (f) repeating steps d)-e) one or more times, until a candidate microbial species has acquired an improved ability to perform the plant-beneficial function of interest.

In one aspect, provided herein is a guided microbial remodeling method for the rational improvement of plant-associated microbes to perform plant-beneficial functions, comprising: (a) providing a plurality of microbial species; (b) assaying the plurality of microbial species for: colonization metrics, transcriptionally active genes under metabolically relevant environmental conditions, and ability to perform a plant-beneficial function of interest; (c) selecting a candidate microbial species from the plurality of assayed microbial species; (d) introducing two or more targeted non-intergeneric genetic variations into the candidate microbial species at two or more target genomic loci, in one or more genomic pathways, or sets of genes, that are associated with a plant-beneficial function of interest, said non-intergeneric genetic variations selected from the group consisting of: full gene deletions, partial gene deletions, promoter insertions, single base pair changes, and combinations thereof; and (e) sequencing the genome of the candidate microbial species and confirming introduction of the non-intergeneric genetic variations at the target genomic loci and absence of any transgenic genetic sequence.

In one aspect, provided is a computationally guided microbial remodeling method for the rational improvement of plant-associated microbes to perform plant-beneficial functions, comprising: (a) accessing a plurality of microbial whole genome sequences; (b) identifying a plurality of regulatory gene sequences that actively regulate the transcription of a gene under a metabolically relevant environmental condition; (c) identifying a plurality of genes associated with a plant-beneficial function; (d) selecting a regulatory gene sequence and a gene associated with a plant-beneficial function from said pluralities; wherein steps a)-d) occur in silico; and (e) manufacturing, in vivo, a remodeled microbial cell that has the selected regulatory gene sequence operably linked to the selected gene associated with a plant-beneficial function, thereby improving the expression of the gene associated with a plant-beneficial function.

In one aspect, provided is a computationally guided microbial remodeling system for the rational improvement of plant-associated microbes to perform plant-beneficial functions, comprising: (a) one or more processors; and (b) one or more memories operatively coupled to the one or more processors and having instructions stored thereon, that when executed by the one or more processors, cause the system to: (i) access a plurality of microbial whole genome sequences; (ii) identify a plurality of regulatory gene sequences that actively regulate the transcription of a gene under a metabolically relevant environmental condition; (iii) identify a plurality of genes associated with a plant-beneficial function; and (iv) select a regulatory gene sequence and a gene associated with a plant-beneficial function from said pluralities.

In one aspect, provided is a computationally guided microbial remodeling method for the rational improvement of plant-associated microbes to perform plant-beneficial functions, comprising: (a) activating a computer system having: one or more processors and one or more memories operatively coupled to the one or more processors and having instructions stored thereon, thereby causing the one or more processors to execute the instructions, and cause the system to: (i) access a plurality of microbial whole genome sequences; (ii) identify a plurality of regulatory gene sequences that actively regulate the transcription of a gene under a metabolically relevant environmental condition; (iii) identify a plurality of genes associated with a plant-beneficial function; (iv) select a regulatory gene sequence and a gene associated with a plant-beneficial function from said pluralities; and (b) manufacturing, in vivo, a remodeled microbial cell that has the selected regulatory gene sequence operably linked to the selected gene associated with a plant-beneficial function, thereby improving the expression of the gene associated with a plant-beneficial function.

BRIEF DESCRIPTION OF THE DRAWINGS

FIG. 1I depicts the use of field data combined with modeling in aspects of the guided microbial remodeling platform.

FIG. 1O illustrates the inefficiency of current nitrogen delivery systems, which result in underfertilized fields, over fertilized fields, and environmentally deleterious nitrogen runoff

FIGS. 3A-3E illustrate derivative microbes that fix and excrete nitrogen in vitro under conditions similar to high nitrate agricultural soils. FIG. 3A illustrates the regulatory network controlling nitrogen fixation and assimilation in PBC6.1 is shown, including the key nodes NifL, NifA, GS, GlnE depicted as the two-domain ATase-AR enzyme, and AmtB. FIG. 3B illustrates the genome of *Kosakonia sacchari* isolate PBC6.1. The three tracks circumscribing the genome convey transcription data from PBC6.1, PBC6.38, and the differential expression between the strains respectively. FIG. 3C illustrates the nitrogen fixation gene cluster and transcription data is expanded for finer detail. FIG. 3D illustrates nitrogenase activity under varying concentrations of exogenous nitrogen is measured with the acetylene reduction assay. The wild type strain exhibits repression of nitrogenase activity as glutamine concentrations increase, while derivative strains show varying degrees of robustness. In the line graph, triangles represent strain PBC6.22; circles represent strain PBC6.1; squares represent strain PBC6.15; and diamonds represent strain PBC6.14. Error bars represent standard error of the mean of at least three biological replicates. FIG. 3E illustrates temporal excretion of ammonia by derivative strains is observed at mM concentrations. Wild type strains are not observed to excrete fixed nitrogen, and negligible ammonia accumulates in the media. Error bars represent standard error of the mean.

FIGS. 5A-5C illustrate greenhouse experiments that demonstrate microbial nitrogen fixation in corn. FIG. 5A illustrates microbe colonization six weeks after inoculation of corn plants by PBC6.1 derivative strains. Error bars show standard error of the mean of at least eight biological replicates. FIG. 5B illustrates in planta transcription of nifH measured by extraction of total RNA from roots and subsequent Nanostring analysis. Only derivative strains show nifH transcription in the root environment. Error bars show standard error of the mean of at least 3 biological replicates. FIG. 5C illustrates microbial nitrogen fixation measured by the dilution of isotopic tracer in plant tissues. Derivative microbes exhibit substantial transfer of fixed nitrogen to the plant. Error bars show standard error of the mean of at least ten biological replicates.

FIG. 28 illustrates average microbial colonization in corn three weeks after planting. The corn seed was inoculated at planting by CI137 WT and derivative strains described in Example 7.

DETAILED DESCRIPTION OF THE DISCLOSURE

Figure 1A:
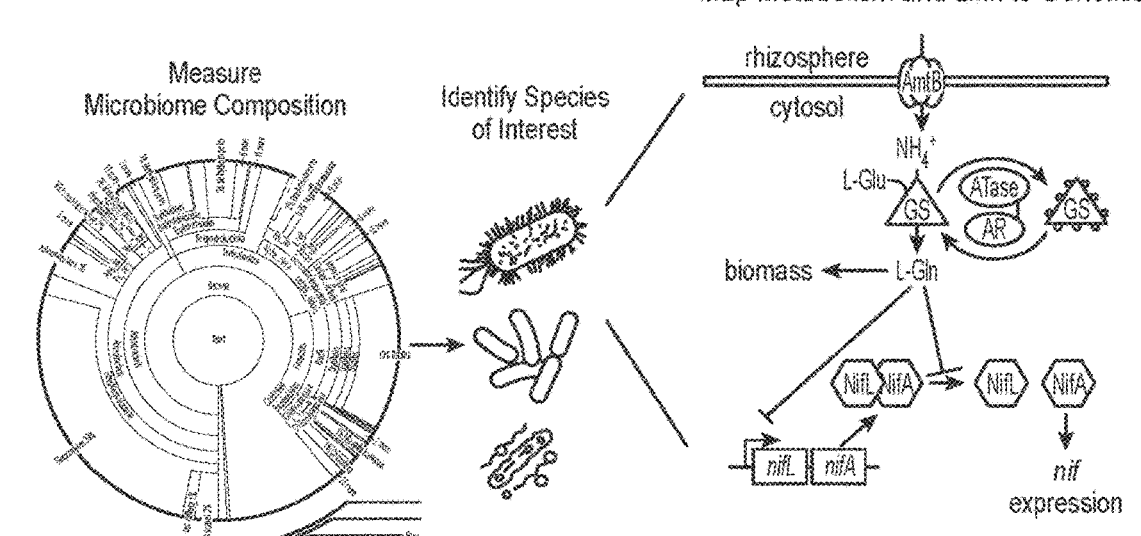
FIG. 1A depicts an overview of the guided microbial remodeling process, in accordance with embodiments.
Figure 1A:
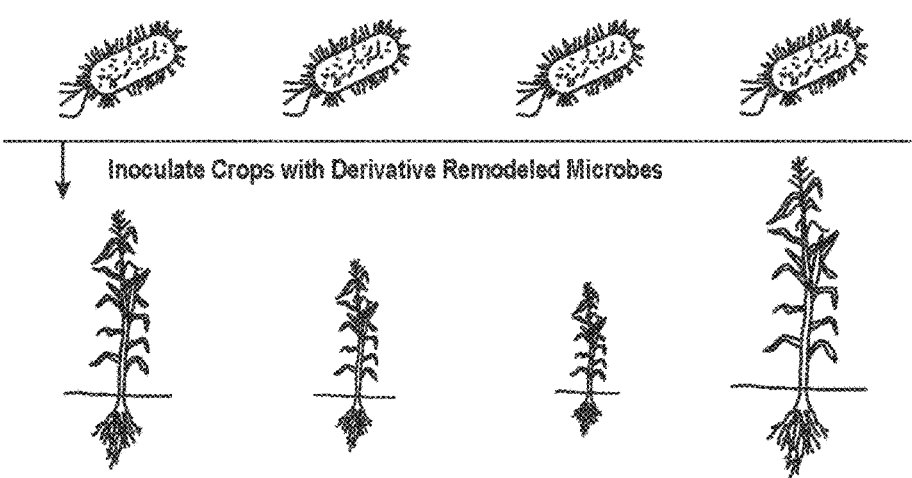

While various embodiments of the disclosure have been shown and described herein, it will be obvious to those skilled in the art that such embodiments are provided by way of example only. Numerous variations, changes, and substitutions may occur to those skilled in the art without departing from the disclosure. It should be understood that various alternatives to the embodiments of the disclosure described herein may be employed.

Increased fertilizer utilization brings with it environmental concerns and is also likely not possible for many economically stressed regions of the globe. Furthermore, many industry players in the microbial arena are focused on creating intergeneric microbes. However, there is a heavy regulatory burden placed on engineered microbes that are characterized/classified as intergeneric. These intergeneric microbes face not only a higher regulatory burden, which makes widespread adoption and implementation difficult, but they also face a great deal of public perception scrutiny.

Currently, there are no engineered microbes on the market that are non-intergeneric and that are capable of increasing nitrogen fixation in non-leguminous crops. This dearth of such a microbe is a missing element in helping to usher in a truly environmentally friendly and more sustainable 21$^{st}$ century agricultural system.

The present disclosure solves the aforementioned problems and provides a non-intergeneric microbe that has been engineered to readily fix nitrogen in crops. These microbes are not characterized/classified as intergeneric microbes and thus will not face the steep regulatory burdens of such. Further, the taught non-intergeneric microbes will serve to help 21$^{st}$ century farmers become less dependent upon utilizing ever increasing amounts of exogenous nitrogen fertilizer.

Definitions

The use of the terms "a" and "an" and "the" and similar referents in the context of describing the disclosure (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. For example, if the range 10-15 is disclosed, then 11, 12, 13, and 14 are also disclosed. All methods described herein can be performed in any suitable order unless otherwise indicated herein or otherwise clearly contradicted by context. The use of any and all examples, or exemplary language (e.g., "such as") provided herein, is intended merely to better illuminate the disclosure and does not pose a limitation on the scope of the disclosure unless otherwise claimed. No language in the specification should be construed as indicating any non-claimed element as essential to the practice of the disclosure.

The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

"Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner according to base complementarity. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the enzymatic cleavage of a polynucleotide by an endonuclease. A second sequence that is complementary to a first sequence is referred to as the "complement" of the first sequence. The term "hybridizable" as applied to a polynucleotide refers to the ability of the polynucleotide to form a complex that is stabilized via hydrogen bonding between the bases of the nucleotide residues in a hybridization reaction.

"Complementarity" refers to the ability of a nucleic acid to form hydrogen bond(s) with another nucleic acid sequence by either traditional Watson-Crick or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary, respectively). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. Sequence identity, such as for the purpose of assessing percent complementarity, may be measured by any suitable alignment algorithm, including but not limited to the Needleman-Wunsch algorithm (see e.g. the EMBOSS Needle aligner available at www.ebi.ac.uk/Tools/psa/emboss_needle/nucleotide.html, optionally with default settings), the BLAST algorithm (see e.g. the BLAST alignment tool available at blast.ncbi.nlm.nih.gov/Blast.cgi, optionally with default settings), or the Smith-Waterman algorithm (see the EMBOSS at e.g. Water aligner available www.ebi.ac.uk/Tools/psa/emboss_water/nucleotide.html, optionally with default settings). Optimal alignment may be assessed using any suitable parameters of a chosen algorithm, including default parameters.

In general, "stringent conditions" for hybridization refer to conditions under which a nucleic acid having complementarity to a target sequence predominantly hybridizes with a target sequence, and substantially does not hybridize to non-target sequences. Stringent conditions are generally sequence-dependent and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y.

As used herein, "expression" refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

The terms "polypeptide", "peptide" and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics.

As used herein, the term "about" is used synonymously with the term "approximately." Illustratively, the use of the term "about" with regard to an amount indicates that values slightly outside the cited values, e.g., plus or minus 0.1% to 10%.

The term "biologically pure culture" or "substantially pure culture" refers to a culture of a bacterial species described herein containing no other bacterial species in quantities sufficient to interfere with the replication of the culture or be detected by normal bacteriological techniques.

"Plant productivity" refers generally to any aspect of growth or development of a plant that is a reason for which the plant is grown. For food crops, such as grains or vegetables, "plant productivity" can refer to the yield of grain or fruit harvested from a particular crop. As used herein, improved plant productivity refers broadly to improvements in yield of grain, fruit, flowers, or other plant parts harvested for various purposes, improvements in growth of plant parts, including stems, leaves and roots, promotion of plant growth, maintenance of high chlorophyll content in leaves, increasing fruit or seed numbers, increasing fruit or seed unit weight, reducing $NO_2$ emission due to reduced nitrogen fertilizer usage and similar improvements of the growth and development of plants.

Microbes in and around food crops can influence the traits of those crops. Plant traits that may be influenced by microbes include: yield (e.g., grain production, biomass generation, fruit development, flower set); nutrition (e.g., nitrogen, phosphorus, potassium, iron, micronutrient acquisition); abiotic stress management (e.g., drought tolerance, salt tolerance, heat tolerance); and biotic stress management (e.g., pest, weeds, insects, fungi, and bacteria). Strategies for altering crop traits include: increasing key metabolite concentrations; changing temporal dynamics of microbe influence on key metabolites; linking microbial metabolite production/degradation to new environmental cues; reducing negative metabolites; and improving the balance of metabolites or underlying proteins.

As used herein, a "control sequence" refers to an operator, promoter, silencer, or terminator.

As used herein, "in planta" may refer to in the plant, on the plant, or intimately associated with the plant, depending upon context of usage (e.g. endophytic, epiphytic, or rhizospheric associations). The plant may comprise plant parts, tissue, leaves, roots, root hairs, rhizomes, stems, seed, ovules, pollen, flowers, fruit, etc.

In some embodiments, native or endogenous control sequences of genes of the present disclosure are replaced with one or more intrageneric control sequences.

As used herein, "introduced" refers to the introduction by means of modern biotechnology, and not a naturally occurring introduction.

In some embodiments, the bacteria of the present disclosure have been modified such that they are not naturally occurring bacteria.

In some embodiments, the bacteria of the present disclosure are present in the plant in an amount of at least $10^3$ cfu, $10^4$ cfu, $10^5$ cfu, $10^6$ cfu, $10^7$ cfu, $10^8$ cfu, $10^9$ cfu, $10^{10}$ cfu, $10^{11}$ cfu, or $10^{12}$ cfu per gram of fresh or dry weight of the plant. In some embodiments, the bacteria of the present disclosure are present in the plant in an amount of at least about $10^3$ cfu, about $10^4$ cfu, about $10^5$ cfu, about $10^6$ cfu, about $10^7$ cfu, about $10^8$ cfu, about $10^9$ cfu, about $10^{10}$ cfu, about $10^{11}$ cfu, or about $10^{12}$ cfu per gram of fresh or dry weight of the plant. In some embodiments, the bacteria of the present disclosure are present in the plant in an amount of at least $10^3$ to $10^9$, $10^3$ to $10^7$, $10^3$ to $10^5$, $10^5$ to $10^9$, $10^5$ to $10^7$, $10^6$ to $10^{10}$, $10^6$ to $10^7$ cfu per gram of fresh or dry weight of the plant.

Fertilizers and exogenous nitrogen of the present disclosure may comprise the following nitrogen-containing molecules: ammonium, nitrate, nitrite, ammonia, glutamine, etc. Nitrogen sources of the present disclosure may include anhydrous ammonia, ammonia sulfate, urea, diammonium phosphate, urea-form, monoammonium phosphate, ammonium nitrate, nitrogen solutions, calcium nitrate, potassium nitrate, sodium nitrate, etc.

As used herein, "exogenous nitrogen" refers to non-atmospheric nitrogen readily available in the soil, field, or growth medium that is present under non-nitrogen limiting conditions, including ammonia, ammonium, nitrate, nitrite, urea, uric acid, ammonium acids, etc.

As used herein, "non-nitrogen limiting conditions" refers to non-atmospheric nitrogen available in the soil, field, media at concentrations greater than about 4 mM nitrogen, as disclosed by Kant et al. (2010. J. Exp. Biol. 62 (4): 1499-1509), which is incorporated herein by reference.

As used herein, an "intergeneric microorganism" is a microorganism that is formed by the deliberate combination of genetic material originally isolated from organisms of different taxonomic genera. An "intergeneric mutant" can be used interchangeably with "intergeneric microorganism". An exemplary "intergeneric microorganism" includes a microorganism containing a mobile genetic element that was first identified in a microorganism in a genus different from the recipient microorganism. Further explanation can be found, inter alia, in 40 C.F.R. § 725.3.

In aspects, microbes taught herein are "non-intergeneric," which means that the microbes are not intergeneric.

As used herein, an "intrageneric microorganism" is a microorganism that is formed by the deliberate combination of genetic material originally isolated from organisms of the same taxonomic genera. An "intrageneric mutant" can be used interchangeably with "intrageneric microorganism".

As used herein, "introduced genetic material" means genetic material that is added to, and remains as a component of, the genome of the recipient.

As used herein, in the context of non-intergeneric microorganisms, the term "remodeled" is used synonymously with the term "engineered". Consequently, a "non-intergeneric remodeled microorganism" has a synonymous meaning to "non-intergeneric engineered microorganism," and will be utilized interchangeably. Further, the disclosure may refer to an "engineered strain" or "engineered derivative" or "engineered non-intergeneric microbe," these terms are used synonymously with "remodeled strain" or "remodeled derivative" or "remodeled non-intergeneric microbe."

In some embodiments, the nitrogen fixation and assimilation genetic regulatory network comprises polynucleotides encoding genes and non-coding sequences that direct, modulate, and/or regulate microbial nitrogen fixation and/or assimilation and can comprise polynucleotide sequences of the nif cluster (e.g., nifA, nifB, nifC, . . . nifZ), polynucleotides encoding nitrogen regulatory protein C, polynucleotides encoding nitrogen regulatory protein B, polynucleotide sequences of the gln cluster (e.g. glnA and glnD), draT, and ammonia transporters/permeases. In some cases, the Nif cluster may comprise NifB, NifH, NifD, NifK, NifE, NifN, NifX, hesa, and NifV. In some cases, the Nif cluster may comprise a subset of NifB, NifH, NifD, NifK, NifE, NifN, NifX, hesa, and NifV.

In some embodiments, fertilizer of the present disclosure comprises at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% nitrogen by weight.

In some embodiments, fertilizer of the present disclosure comprises at least about 5%, about 6%, about 7%, about 8%, about 9%, about 10%, about 11%, about 12%, about 13%, about 14%, about 15%, about 16%, about 17%, about 18%, about 19%, about 20%, about 21%, about 22%, about 23%, about 24%, about 25%, about 26%, about 27%, about 28%, about 29%, about 30%, about 31%, about 32%, about 33%, about 34%, about 35%, about 36%, about 37%, about 38%, about 39%, about 40%, about 41%, about 42%, about 43%, about 44%, about 45%, about 46%, about 47%, about 48%, about 49%, about 50%, about 51%, about 52%, about 53%, about 54%, about 55%, about 56%, about 57%, about 58%, about 59%, about 60%, about 61%, about 62%, about 63%, about 64%, about 65%, about 66%, about 67%, about 68%, about 69%, about 70%, about 71%, about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, or about 99% nitrogen by weight.

In some embodiments, fertilizer of the present disclosure comprises about 5% to 50%, about 5% to 75%, about 10% to 50%, about 10% to 75%, about 15% to 50%, about 15% to 75%, about 20% to 50%, about 20% to 75%, about 25% to 50%, about 25% to 75%, about 30% to 50%, about 30% to 75%, about 35% to 50%, about 35% to 75%, about 40% to 50%, about 40% to 75%, about 45% to 50%, about 45% to 75%, or about 50% to 75% nitrogen by weight.

In some embodiments, the increase of nitrogen fixation and/or the production of 1% or more of the nitrogen in the plant are measured relative to control plants, which have not been exposed to the bacteria of the present disclosure. All increases or decreases in bacteria are measured relative to control bacteria. All increases or decreases in plants are measured relative to control plants.

As used herein, a "constitutive promoter" is a promoter, which is active under most conditions and/or during most development stages. There are several advantages to using constitutive promoters in expression vectors used in biotechnology, such as: high level of production of proteins used to select transgenic cells or organisms; high level of expression of reporter proteins or scorable markers, allowing easy detection and quantification; high level of production of a transcription factor that is part of a regulatory transcription system; production of compounds that requires ubiquitous activity in the organism; and production of compounds that are required during all stages of development. Non-limiting exemplary constitutive promoters include, CaMV 35S promoter, opine promoters, ubiquitin promoter, alcohol dehydrogenase promoter, etc.

As used herein, a "non-constitutive promoter" is a promoter which is active under certain conditions, in certain types of cells, and/or during certain development stages. For example, tissue specific, tissue preferred, cell type specific, cell type preferred, inducible promoters, and promoters under development control are non-constitutive promoters. Examples of promoters under developmental control include promoters that preferentially initiate transcription in certain tissues.

As used herein, "inducible" or "repressible" promoter is a promoter that is under chemical or environmental factor's control. Examples of environmental conditions that may affect transcription by inducible promoters include anaerobic conditions, certain chemicals, the presence of light, acidic or basic conditions, etc.

As used herein, a "tissue specific" promoter is a promoter that initiates transcription only in certain tissues. Unlike constitutive expression of genes, tissue-specific expression is the result of several interacting levels of gene regulation. As such, in the art sometimes it is preferable to use promoters from homologous or closely related species to achieve efficient and reliable expression of transgenes in particular tissues. This is one of the main reasons for the large amount of tissue-specific promoters isolated from particular tissues found in both scientific and patent literature.

As used herein, the term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., that the coding sequence is under the transcriptional control of the promoter). Coding sequences can be operably linked to regulatory sequences in a sense or antisense orientation. In another example, the complementary RNA regions of the disclosure can be operably linked, either directly or indirectly, 5' to the target mRNA, or 3' to the target mRNA, or within the target mRNA, or a first complementary region is 5' and its complement is 3' to the target mRNA.

In aspects, "applying to the plant a plurality of non-intergeneric bacteria," includes any means by which the plant (including plant parts such as a seed, root, stem, tissue, etc.) is made to come into contact (i.e. exposed) with said bacteria at any stage of the plant's life cycle. Consequently, "applying to the plant a plurality of non-intergeneric bacteria," includes any of the following means of exposing the plant (including plant parts such as a seed, root, stem, tissue, etc.) to said bacteria: spraying onto plant, dripping onto plant, applying as a seed coat, applying to a field that will then be planted with seed, applying to a field already planted with seed, applying to a field with adult plants, etc.

As used herein "MRTN" is an acronym for maximum return to nitrogen and is utilized as an experimental treatment in the Examples. MRTN was developed by Iowa State University and information can be found at: cnrc.agron.ia-state.edu. The MRTN is the nitrogen rate where the economic net return to nitrogen application is maximized. The approach to calculating the MRTN is a regional approach for developing corn nitrogen rate guidelines in individual states. The nitrogen rate trial data was evaluated for Illinois, Iowa, Michigan, Minnesota, Ohio, and Wisconsin where an adequate number of research trials were available for corn plantings following soybean and corn plantings following corn. The trials were conducted with spring, sidedress, or split preplant/sidedress applied nitrogen, and sites were not irrigated except for those that were indicated for irrigated sands in Wisconsin. MRTN was developed by Iowa State University due to apparent differences in methods for determining suggested nitrogen rates required for corn production, misperceptions pertaining to nitrogen rate guidelines, and concerns about application rates. By calculating the MRTN, practitioners can determine the following: (1) the nitrogen rate where the economic net return to nitrogen application is maximized, (2) the economic optimum nitrogen rate, which is the point where the last increment of nitrogen returns a yield increase large enough to pay for the additional nitrogen, (3) the value of corn grain increase attributed to nitrogen application, and the maximum yield, which is the yield where application of more nitrogen does not result in a corn yield increase. Thus, the MRTN calculations provide practitioners with the means to maximize corn crops in different regions while maximizing financial gains from nitrogen applications.

The term mmol is an abbreviation for millimole, which is a thousandth ($10^{-3}$) of a mole, abbreviated herein as mol.

As used herein the terms "microorganism" or "microbe" should be taken broadly. These terms, used interchangeably, include but are not limited to, the two prokaryotic domains, Bacteria and Archaea. The term may also encompass eukaryotic fungi and protists.

The term "microbial consortia" or "microbial consortium" refers to a subset of a microbial community of individual microbial species, or strains of a species, which can be described as carrying out a common function, or can be described as participating in, or leading to, or correlating with, a recognizable parameter, such as a phenotypic trait of interest.

The term "microbial community" means a group of microbes comprising two or more species or strains. Unlike microbial consortia, a microbial community does not have to be carrying out a common function, or does not have to be participating in, or leading to, or correlating with, a recognizable parameter, such as a phenotypic trait of interest.

As used herein, "isolate," "isolated," "isolated microbe," and like terms, are intended to mean that the one or more microorganisms has been separated from at least one of the materials with which it is associated in a particular environment (for example soil, water, plant tissue, etc.). Thus, an "isolated microbe" does not exist in its naturally occurring environment; rather, it is through the various techniques described herein that the microbe has been removed from its natural setting and placed into a non-naturally occurring state of existence. Thus, the isolated strain or isolated microbe may exist as, for example, a biologically pure culture, or as spores (or other forms of the strain). In aspects, the isolated microbe may be in association with an acceptable carrier, which may be an agriculturally acceptable carrier.

In certain aspects of the disclosure, the isolated microbes exist as "isolated and biologically pure cultures." It will be appreciated by one of skill in the art that an isolated and biologically pure culture of a particular microbe denotes that said culture is substantially free of other living organisms and contains only the individual microbe in question. The culture can contain varying concentrations of said microbe. The present disclosure notes that isolated and biologically pure microbes often "necessarily differ from less pure or impure materials." See, e.g. *In re Bergstrom,* 427 F.2d 1394, (CCPA 1970) (discussing purified prostaglandins), see also, *In re Bergy,* 596 F.2d 952 (CCPA 1979) (discussing purified microbes), see also, *Parke-Davis & Co. v. H.K. Mulford & Co.,* 189 F. 95 (S.D.N.Y. 1911) (Learned Hand discussing purified adrenaline), aff'd in part, rev'd in part, 196 F. 496 (2d Cir. 1912), each of which are incorporated herein by reference. Furthermore, in some aspects, the disclosure provides for certain quantitative measures of the concentration, or purity limitations, that must be found within an isolated and biologically pure microbial culture. The presence of these purity values, in certain embodiments, is a further attribute that distinguishes the presently disclosed microbes from those microbes existing in a natural state. See, e.g., *Merck & Co. v. Olin Mathieson Chemical Corp.,* 253 F.2d 156 (4th Cir. 1958) (discussing purity limitations for vitamin B12 produced by microbes), incorporated herein by reference.

As used herein, "individual isolates" should be taken to mean a composition, or culture, comprising a predominance of a single genera, species, or strain, of microorganism, following separation from one or more other microorganisms.

Microbes of the present disclosure may include spores and/or vegetative cells. In some embodiments, microbes of the present disclosure include microbes in a viable but non-culturable (VBNC) state. As used herein, "spore" or "spores" refer to structures produced by bacteria and fungi that are adapted for survival and dispersal. Spores are generally characterized as dormant structures; however, spores are capable of differentiation through the process of germination. Germination is the differentiation of spores into vegetative cells that are capable of metabolic activity, growth, and reproduction. The germination of a single spore results in a single fungal or bacterial vegetative cell. Fungal spores are units of asexual reproduction, and in some cases are necessary structures in fungal life cycles. Bacterial spores are structures for surviving conditions that may ordinarily be nonconducive to the survival or growth of vegetative cells.

As used herein, "microbial composition" refers to a composition comprising one or more microbes of the present disclosure. In some embodiments, a microbial composition is administered to plants (including various plant parts) and/or in agricultural fields.

As used herein, "carrier," "acceptable carrier," or "agriculturally acceptable carrier" refers to a diluent, adjuvant, excipient, or vehicle with which the microbe can be administered, which does not detrimentally effect the microbe.

Regulation of Nitrogen Fixation

In some cases, nitrogen fixation pathway may act as a target for genetic engineering and optimization. One trait that may be targeted for regulation by the methods described herein is nitrogen fixation. Nitrogen fertilizer is the largest operational expense on a farm and the biggest driver of higher yields in row crops like corn and wheat. Described herein are microbial products that can deliver renewable forms of nitrogen in non-leguminous crops. While some endophytes have the genetics necessary for fixing nitrogen in pure culture, the fundamental technical challenge is that wild-type endophytes of cereals and grasses stop fixing nitrogen in fertilized fields. The application of chemical fertilizers and residual nitrogen levels in field soils signal the microbe to shut down the biochemical pathway for nitrogen fixation.

Changes to the transcriptional and post-translational levels of components of the nitrogen fixation regulatory network may be beneficial to the development of a microbe capable of fixing and transferring nitrogen to corn in the presence of fertilizer. To that end, described herein is Host-Microbe Evolution (HOME) technology to precisely evolve regulatory networks and elicit novel phenotypes. Also described herein are unique, proprietary libraries of nitrogen-fixing endophytes isolated from corn, paired with extensive omics data surrounding the interaction of microbes and host plant under different environmental conditions like nitrogen stress and excess. In some embodiments, this technology enables precision evolution of the genetic regulatory network of endophytes to produce microbes that actively fix nitrogen even in the presence of fertilizer in the field. Also described herein are evaluations of the technical potential of evolving microbes that colonize corn root tissues and produce nitrogen for fertilized plants and evaluations of the compatibility of endophytes with standard formulation practices and diverse soils to determine feasibility of integrating the microbes into modern nitrogen management strategies.

In order to utilize elemental nitrogen (N) for chemical synthesis, life forms combine nitrogen gas ($N_2$) available in the atmosphere with hydrogen in a process known as nitrogen fixation. Because of the energy-intensive nature of biological nitrogen fixation, diazotrophs (bacteria and archaea that fix atmospheric nitrogen gas) have evolved sophisticated and tight regulation of the nif gene cluster in response to environmental oxygen and available nitrogen. Nif genes encode enzymes involved in nitrogen fixation (such as the nitrogenase complex) and proteins that regulate nitrogen fixation. Shamseldin (2013. Global J. Biotechnol. Biochem. 8 (4): 84-94) discloses detailed descriptions of nif genes and their products, and is incorporated herein by reference. Described herein are methods of producing a plant with an improved trait comprising isolating bacteria from a first plant, introducing a genetic variation into a gene of the isolated bacteria to increase nitrogen fixation, exposing a second plant to the variant bacteria, isolating bacteria from the second plant having an improved trait relative to the first plant, and repeating the steps with bacteria isolated from the second plant.

In Proteobacteria, regulation of nitrogen fixation centers around the σ54-dependent enhancer-binding protein NifA, the positive transcriptional regulator of the nif cluster. Intracellular levels of active NifA are controlled by two key factors: transcription of the nifLA operon, and inhibition of NifA activity by protein-protein interaction with NifL. Both of these processes are responsive to intracellular glutamine levels via the PII protein signaling cascade. This cascade is mediated by GlnD, which directly senses glutamine and catalyzes the uridylylation or deuridylylation of two PII regulatory proteins-GlnB and GlnK—in response the absence or presence, respectively, of bound glutamine. Under conditions of nitrogen excess, unmodified GlnB signals the deactivation of the nifLA promoter. However, under conditions of nitrogen limitation, GlnB is post-translationally modified, which inhibits its activity and leads to transcription of the nifLA operon. In this way, nifLA transcription is tightly controlled in response to environmental nitrogen via the PII protein signaling cascade. On the post-translational level of NifA regulation, GlnK inhibits the NifL/NifA interaction in a matter dependent on the overall level of free GlnK within the cell.

NifA is transcribed from the nifLA operon, whose promoter is activated by phosphorylated NtrC, another σ54-dependent regulator. The phosphorylation state of NtrC is mediated by the histidine kinase NtrB, which interacts with deuridylylated GlnB but not uridylylated GlnB. Under conditions of nitrogen excess, a high intracellular level of glutamine leads to deuridylylation of GlnB, which then interacts with NtrB to deactivate its phosphorylation activity and activate its phosphatase activity, resulting in dephosphorylation of NtrC and the deactivation of the nifLA promoter. However, under conditions of nitrogen limitation, a low level of intracellular glutamine results in uridylylation of GlnB, which inhibits its interaction with NtrB and allows the phosphorylation of NtrC and transcription of the nifLA operon. In this way, nifLA expression is tightly controlled in response to environmental nitrogen via the PII protein signaling cascade. nifA, ntrB, ntrC, and glnB, are all genes that can be mutated in the methods described herein. These processes may also be responsive to intracellular or extracellular levels of ammonia, urea or nitrates.

The activity of NifA is also regulated post-translationally in response to environmental nitrogen, most typically through NifL-mediated inhibition of NifA activity. In general, the interaction of NifL and NifA is influenced by the PII protein signaling cascade via GlnK, although the nature of the interactions between GlnK and NifL/NifA varies significantly between diazotrophs. In *Klebsiella pneumoniae*, both forms of GlnK inhibit the NifL/NifA interaction, and the interaction between GlnK and NifL/NifA is determined by the overall level of free GlnK within the cell. Under nitrogen-excess conditions, deuridylylated GlnK interacts with the ammonium transporter AmtB, which serves to both block ammonium uptake by AmtB and sequester GlnK to the membrane, allowing inhibition of NifA by NifL. On the other hand, in *Azotobacter vinelandii*, interaction with deuridylylated GlnK is required for the NifL/NifA interaction and NifA inhibition, while uridylylation of GlnK inhibits its interaction with NifL. In diazotrophs lacking the nifL gene, there is evidence that NifA activity is inhibited directly by interaction with the deuridylylated forms of both GlnK and GlnB under nitrogen-excess conditions. In some bacteria the Nif cluster may be regulated by glnR, and further in some cases this may comprise negative regulation. Regardless of the mechanism, post-translational inhibition of NifA is an important regulator of the nif cluster in most known diazotrophs. Additionally, nifL, amtB, glnK, and glnR are genes that can be mutated in the methods described herein.

In addition to regulating the transcription of the nif gene cluster, many diazotrophs have evolved a mechanism for the direct post-translational modification and inhibition of the nitrogenase enzyme itself, known as nitrogenase shutoff. This is mediated by ADP-ribosylation of the Fe protein (NifH) under nitrogen-excess conditions, which disrupts its interaction with the MoFe protein complex (NifDK) and abolishes nitrogenase activity. DraT catalyzes the ADP-ribosylation of the Fe protein and shutoff of nitrogenase, while DraG catalyzes the removal of ADP-ribose and reactivation of nitrogenase. As with nifLA transcription and NifA inhibition, nitrogenase shutoff is also regulated via the PII protein signaling cascade. Under nitrogen-excess conditions, deuridylylated GlnB interacts with and activates DraT, while deuridylylated GlnK interacts with both DraG and AmtB to form a complex, sequestering DraG to the membrane. Under nitrogen-limiting conditions, the uridylylated forms of GlnB and GlnK do not interact with DraT and DraG, respectively, leading to the inactivation of DraT and the diffusion of DraG to the Fe protein, where it removes the ADP-ribose and activates nitrogenase. The methods described herein also contemplate introducing genetic variation into the nifH, nifD, nifK, and draT genes.

Although some endophytes have the ability to fix nitrogen in vitro, often the genetics are silenced in the field by high levels of exogenous chemical fertilizers. One can decouple the sensing of exogenous nitrogen from expression of the nitrogenase enzyme to facilitate field-based nitrogen fixation. Improving the integral of nitrogenase activity across time further serves to augment the production of nitrogen for utilization by the crop. Specific targets for genetic variation to facilitate field-based nitrogen fixation using the methods described herein include one or more genes selected from the group consisting of nifA, nifL, ntrB, ntrC, glnA, glnB, glnK, draT, amtB, glnD, glnE, nifJ, nifH, nifD, nifK, nifY, nifE, nifN, nifU, nifS, nifV, nifW, nifZ, nifM, nifF, nifB, and nifQ.

An additional target for genetic variation to facilitate field-based nitrogen fixation using the methods described herein is the NifA protein. The NifA protein is typically the activator for expression of nitrogen fixation genes. Increasing the production of NifA (either constitutively or during high ammonia condition) circumvents the native ammonia-sensing pathway. In addition, reducing the production of NifL proteins, a known inhibitor of NifA, also leads to an increased level of freely active NifA. In addition, increasing the transcription level of the nifAL operon (either constitutively or during high ammonia condition) also leads to an overall higher level of NifA proteins. Elevated level of nifAL expression is achieved by altering the promoter itself or by reducing the expression of NtrB (part of ntrB and ntrC signaling cascade that originally would result in the shutoff of nifAL operon during high nitrogen condition). High level of NifA achieved by these or any other methods described herein increases the nitrogen fixation activity of the endophytes.

Another target for genetic variation to facilitate field-based nitrogen fixation using the methods described herein is the GlnD/GlnB/GlnK PII signaling cascade. The intracellular glutamine level is sensed through the GlnD/GlnB/GlnK PII signaling cascade. Active site mutations in GlnD that abolish the uridylyl-removing activity of GlnD disrupt the nitrogen-sensing cascade. In addition, reduction of the GlnB concentration short circuits the glutamine-sensing cascade. These mutations "trick" the cells into perceiving a nitrogen-limited state, thereby increasing the nitrogen fixation level activity. These processes may also be responsive to intracellular or extracellular levels of ammonia, urea or nitrates.

The amtB protein is also a target for genetic variation to facilitate field-based nitrogen fixation using the methods described herein. Ammonia uptake from the environment can be reduced by decreasing the expression level of amtB protein. Without intracellular ammonia, the endophyte is not able to sense the high level of ammonia, preventing the down-regulation of nitrogen fixation genes. Any ammonia that manages to get into the intracellular compartment is converted into glutamine. Intracellular glutamine level is the major currency of nitrogen sensing. Decreasing the intracellular glutamine level prevents the cells from sensing high ammonium levels in the environment. This effect can be achieved by increasing the expression level of glutaminase, an enzyme that converts glutamine into glutamate. In addition, intracellular glutamine can also be reduced by decreasing glutamine synthase (an enzyme that converts ammonia into glutamine). In diazotrophs, fixed ammonia is quickly assimilated into glutamine and glutamate to be used for cellular processes. Disruptions to ammonia assimilation may enable diversion of fixed nitrogen to be exported from the cell as ammonia. The fixed ammonia is predominantly assimilated into glutamine by glutamine synthetase (GS), encoded by glnA, and subsequently into glutamine by glutamine oxoglutarate aminotransferase (GOGAT). In some examples, glnS encodes a glutamine synthetase. GS is regulated post-translationally by GS adenylyl transferase (GlnE), a bi-functional enzyme encoded by glnE that catalyzes both the adenylylation and de-adenylylation of GS through activity of its adenylyl-transferase (AT) and adenylyl-removing (AR) domains, respectively. Under nitrogen limiting conditions, glnA is expressed, and GlnE's AR domain de-adynylylates GS, allowing it to be active. Under conditions of nitrogen excess, glnA expression is turned off, and GlnE's AT domain is activated allosterically by glutamine, causing the adenylylation and deactivation of GS.

Furthermore, the draT gene may also be a target for genetic variation to facilitate field-based nitrogen fixation using the methods described herein. Once nitrogen fixing enzymes are produced by the cell, nitrogenase shut-off represents another level in which cell downregulates fixation activity in high nitrogen condition. This shut-off could be removed by decreasing the expression level of DraT.

Methods for imparting new microbial phenotypes can be performed at the transcriptional, translational, and post-translational levels. The transcriptional level includes changes at the promoter (such as changing sigma factor affinity or binding sites for transcription factors, including deletion of all or a portion of the promoter) or changing transcription terminators and attenuators. The translational level includes changes at the ribosome binding sites and changing mRNA degradation signals. The post-translational level includes mutating an enzyme's active site and changing protein-protein interactions. These changes can be achieved in a multitude of ways. Reduction of expression level (or complete abolishment) can be achieved by swapping the native ribosome binding site (RBS) or promoter with another with lower strength/efficiency. ATG start sites can be swapped to a GTG, TTG, or CTG start codon, which results in reduction in translational activity of the coding region. Complete abolishment of expression can be done by knocking out (deleting) the coding region of a gene. Frame-shifting the open reading frame (ORF) likely will result in a premature stop codon along the ORF, thereby creating a non-functional truncated product. Insertion of in-frame stop codons will also similarly create a non-functional truncated product. Addition of a degradation tag at the N or C terminal can also be done to reduce the effective concentration of a particular gene.

Conversely, expression level of the genes described herein can be achieved by using a stronger promoter. To ensure high promoter activity during high nitrogen level condition (or any other condition), a transcription profile of the whole genome in a high nitrogen level condition could be obtained and active promoters with a desired transcription level can be chosen from that dataset to replace the weak promoter. Weak start codons can be swapped out with an ATG start codon for better translation initiation efficiency. Weak ribosomal binding sites (RBS) can also be swapped out with a different RBS with higher translation initiation efficiency. In addition, site specific mutagenesis can also be performed to alter the activity of an enzyme.

Increasing the level of nitrogen fixation that occurs in a plant can lead to a reduction in the amount of chemical fertilizer needed for crop production and reduce greenhouse gas emissions (e.g., nitrous oxide).

Regulation of Colonization Potential

One trait that may be targeted for regulation by the methods described herein is colonization potential. Accordingly, in some embodiments, pathways and genes involved in colonization may act as a target for genetic engineering and optimization.

In some cases, exopolysaccharides may be involved in bacterial colonization of plants. In some cases, plant colonizing microbes may produce a biofilm. In some cases, plant colonizing microbes secrete molecules which may assist in adhesion to the plant, or in evading a plant immune response. In some cases, plant colonizing microbes may excrete signaling molecules which alter the plants response to the microbes. In some cases, plant colonizing microbes may secrete molecules which alter the local microenvironment. In some cases, a plant colonizing microbe may alter expression of genes to adapt to a plant said microbe is in proximity to. In some cases, a plant colonizing microbe may detect the presence of a plant in the local environment and may change expression of genes in response.

In some embodiments, to improve colonization, a gene involved in a pathway selected from the group consisting of: exopolysaccharide production, endo-polygalaturonase production, trehalose production, and glutamine conversion may be targeted for genetic engineering and optimization.

In some embodiments, an enzyme or pathway involved in production of exopolysaccharides may be genetically modified to improve colonization. Exemplary genes encoding an exopolysaccharide producing enzyme that may be targeted to improve colonization include, but are not limited to, bcsii, bcsiii, and yjbE.

In some embodiments, an enzyme or pathway involved in production of a filamentous hemagglutinin may be genetically modified to improve colonization. For example, a fhaB gene encoding a filamentous hemagglutinin may be targeted to improve colonization.

In some embodiments, an enzyme or pathway involved in production of an endo-polygalaturonase may be genetically modified to improve colonization. For example, a pehA gene encoding an endo-polygalaturonase precursor may be targeted to improve colonization.

In some embodiments, an enzyme or pathway involved in production of trehalose may be genetically modified to improve colonization. Exemplary genes encoding a trehalose producing enzyme that may be targeted to improve colonization include, but are not limited to, otsB and treZ.

In some embodiments, an enzyme or pathway involved in conversion of glutamine may be genetically modified to improve colonization. For example, the glsA2 gene encodes a glutaminase which converts glutamine into ammonium and glutamate. Upregulating glsA2 improves fitness by increasing the cell's glutamate pool, thereby increasing available N to the cells. Accordingly, in some embodiments, the glsA2 gene may be targeted to improve colonization.

In some embodiments, colonization genes selected from the group consisting of: bcsii, bcsiii, yjbE, fhaB, pehA, otsB, treZ, glsA2, and combinations thereof, may be genetically modified to improve colonization.

Colonization genes that may be targeted to improve the colonization potential are also described in a PCT publication, WO/2019/032926, which is incorporated by reference herein in its entirety.

Generation of Bacterial Populations

Isolation of Bacteria

Microbes useful in methods and compositions disclosed herein can be obtained by extracting microbes from surfaces or tissues of native plants. Microbes can be obtained by grinding seeds to isolate microbes. Microbes can be obtained by planting seeds in diverse soil samples and recovering microbes from tissues. Additionally, microbes can be obtained by inoculating plants with exogenous microbes and determining which microbes appear in plant tissues. Non-limiting examples of plant tissues may include a seed, seedling, leaf, cutting, plant, bulb, or tuber.

A method of obtaining microbes may be through the isolation of bacteria from soils. Bacteria may be collected from various soil types. In some example, the soil can be characterized by traits such as high or low fertility, levels of moisture, levels of minerals, and various cropping practices. For example, the soil may be involved in a crop rotation where different crops are planted in the same soil in successive planting seasons. The sequential growth of different crops on the same soil may prevent disproportionate depletion of certain minerals. The bacteria can be isolated from the plants growing in the selected soils. The seedling plants can be harvested at 2-6 weeks of growth. For example, at least 400 isolates can be collected in a round of harvest. Soil and plant types reveal the plant phenotype as well as the conditions, which allow for the downstream enrichment of certain phenotypes.

Microbes can be isolated from plant tissues to assess microbial traits. The parameters for processing tissue samples may be varied to isolate different types of associative microbes, such as rhizopheric bacteria, epiphytes, or endophytes. The isolates can be cultured in nitrogen-free media to enrich for bacteria that perform nitrogen fixation. Alternatively, microbes can be obtained from global strain banks.

In planta analytics are performed to assess microbial traits. In some embodiments, the plant tissue can be processed for screening by high throughput processing for DNA and RNA. Additionally, non-invasive measurements can be used to assess plant characteristics, such as colonization. Measurements on wild microbes can be obtained on a plant-by-plant basis. Measurements on wild microbes can also be obtained in the field using medium throughput methods. Measurements can be done successively over time. Model plant system can be used including, but not limited to, *Setaria*.

Microbes in a plant system can be screened via transcriptional profiling of a microbe in a plant system. Examples of screening through transcriptional profiling are using methods of quantitative polymerase chain reaction (qPCR), molecular barcodes for transcript detection, Next Generation Sequencing, and microbe tagging with fluorescent markers. Impact factors can be measured to assess colonization in the greenhouse including, but not limited to, microbiome, abiotic factors, soil conditions, oxygen, moisture, temperature, inoculum conditions, and root localization. Nitrogen fixation can be assessed in bacteria by measuring 15N gas/fertilizer (dilution) with IRMS or NanoSIMS as described herein NanoSIMS is high-resolution secondary ion mass spectrometry. The NanoSIMS technique is a way to investigate chemical activity from biological samples. The catalysis of reduction of oxidation reactions that drive the metabolism of microorganisms can be investigated at the cellular, subcellular, molecular and elemental level. NanoSIMS can provide high spatial resolution of greater than 0.1 μm. NanoSIMS can detect the use of isotope tracers such as $^{13}C$, $^{15}N$, and $^{18}O$. Therefore, NanoSIMS can be used to the chemical activity nitrogen in the cell.

Automated greenhouses can be used for in planta analytics. Plant metrics in response to microbial exposure include, but are not limited to, biomass, chloroplast analysis, CCD camera, volumetric tomography measurements.

One way of enriching a microbe population is according to genotype. For example, a polymerase chain reaction (PCR) assay with a targeted primer or specific primer. Primers designed for the nifH gene can be used to identity diazotrophs because diazotrophs express the nifH gene in the process of nitrogen fixation. A microbial population can also be enriched via single-cell culture-independent approaches and chemotaxis-guided isolation approaches. Alternatively, targeted isolation of microbes can be performed by culturing the microbes on selection media. Premeditated approaches to enriching microbial populations for desired traits can be guided by bioinformatics data and are described herein.

Enriching for Microbes with Nitrogen Fixation Capabilities Using Bioinformatics

Bioinformatics tools can be used to identify and isolate plant growth promoting rhizobacteria (PGPRs), which are selected based on their ability to perform nitrogen fixation. Microbes with high nitrogen fixing ability can promote favorable traits in plants. Bioinformatic modes of analysis for the identification of PGPRs include, but are not limited to, genomics, metagenomics, targeted isolation, gene sequencing, transcriptome sequencing, and modeling.

Genomics analysis can be used to identify PGPRs and confirm the presence of mutations with methods of Next Generation Sequencing as described herein and microbe version control.

Metagenomics can be used to identify and isolate PGPR using a prediction algorithm for colonization. Metadata can also be used to identify the presence of an engineered strain in environmental and greenhouse samples.

Transcriptomic sequencing can be used to predict genotypes leading to PGPR phenotypes. Additionally, transcriptomic data is used to identify promoters for altering gene expression. Transcriptomic data can be analyzed in conjunction with the Whole Genome Sequence (WGS) to generate models of metabolism and gene regulatory networks.

Domestication of Microbes

Microbes isolated from nature can undergo a domestication process wherein the microbes are converted to a form that is genetically trackable and identifiable. One way to domesticate a microbe is to engineer it with antibiotic resistance. The process of engineering antibiotic resistance can begin by determining the antibiotic sensitivity in the wild type microbial strain. If the bacteria are sensitive to the antibiotic, then the antibiotic can be a good candidate for antibiotic resistance engineering. Subsequently, an antibiotic resistant gene or a counterselectable suicide vector can be incorporated into the genome of a microbe using recombineering methods. A counterselectable suicide vector may consist of a deletion of the gene of interest, a selectable marker, and the counterselectable marker sacB. Counterselection can be used to exchange native microbial DNA sequences with antibiotic resistant genes. A medium throughput method can be used to evaluate multiple microbes simultaneously allowing for parallel domestication. Alternative methods of domestication include the use of homing nucleases to prevent the suicide vector sequences from looping out or from obtaining intervening vector sequences.

DNA vectors can be introduced into bacteria via several methods including electroporation and chemical transformations. A standard library of vectors can be used for transformations. An example of a method of gene editing is CRISPR preceded by Cas9 testing to ensure activity of Cas9 in the microbes.

Non-Transgenic Engineering of Microbes

A microbial population with favorable traits can be obtained via directed evolution. Direct evolution is an approach wherein the process of natural selection is mimicked to evolve proteins or nucleic acids towards a user-defined goal. An example of direct evolution is when random mutations are introduced into a microbial population, the microbes with the most favorable traits are selected, and the growth of the selected microbes is continued. The most favorable traits in growth promoting rhizobacteria (PGPRs) may be in nitrogen fixation. The method of directed evolution may be iterative and adaptive based on the selection process after each iteration.

Plant growth promoting rhizobacteria (PGPRs) with high capability of nitrogen fixation can be generated. The evolution of PGPRs can be carried out via the introduction of genetic variation. Genetic variation can be introduced via polymerase chain reaction mutagenesis, oligonucleotide-directed mutagenesis, saturation mutagenesis, fragment shuffling mutagenesis, homologous recombination, CRISPR/Cas9 systems, chemical mutagenesis, and combinations thereof. These approaches can introduce random mutations into the microbial population. For example, mutants can be generated using synthetic DNA or RNA via oligonucleotide-directed mutagenesis. Mutants can be generated using tools contained on plasmids, which are later cured. Genes of interest can be identified using libraries from other species with improved traits including, but not limited to, improved PGPR properties, improved colonization of cereals, increased oxygen sensitivity, increased nitrogen fixation, and increased ammonia excretion. Intrageneric genes can be designed based on these libraries using software such as Geneious or Platypus design software. Mutations can be designed with the aid of machine learning. Mutations can be designed with the aid of a metabolic model. Automated design of the mutation can be done using a la Platypus and will guide RNAs for Cas-directed mutagenesis.

The intra-generic genes can be transferred into the host microbe. Additionally, reporter systems can also be transferred to the microbe. The reporter systems characterize promoters, determine the transformation success, screen mutants, and act as negative screening tools.

The microbes carrying the mutation can be cultured via serial passaging. A microbial colony contains a single variant of the microbe. Microbial colonies are screened with the aid of an automated colony picker and liquid handler. Mutants with gene duplication and increased copy number express a higher genotype of the desired trait.

Selection of Plant Growth Promoting Microbes Based on Nitrogen Fixation

The microbial colonies can be screened using various assays to assess nitrogen fixation. One way to measure nitrogen fixation is via a single fermentative assay, which measures nitrogen excretion. An alternative method is the acetylene reduction assay (ARA) with in-line sampling over time. ARA can be performed in high throughput plates of microtube arrays. ARA can be performed with live plants and plant tissues. The media formulation and media oxygen concentration can be varied in ARA assays. Another method of screening microbial variants is by using biosensors. The use of NanoSIMS and Raman microspectroscopy can be used to investigate the activity of the microbes. In some cases, bacteria can also be cultured and expanded using methods of fermentation in bioreactors. The bioreactors are designed to improve robustness of bacteria growth and to decrease the sensitivity of bacteria to oxygen. Medium to high TP plate-based microfermentors are used to evaluate oxygen sensitivity, nutritional needs, nitrogen fixation, and nitrogen excretion. The bacteria can also be co-cultured with competitive or beneficial microbes to elucidate cryptic pathways. Flow cytometry can be used to screen for bacteria that produce high levels of nitrogen using chemical, colorimetric, or fluorescent indicators. The bacteria may be cultured in the presence or absence of a nitrogen source. For example, the bacteria may be cultured with glutamine, ammonia, urea or nitrates.

Guided Microbial Remodeling—An Overview

Guided microbial remodeling is a method to systematically identify and improve the role of species within the crop microbiome. In some aspects, and according to a particular methodology of grouping/categorization, the method comprises three steps: 1) selection of candidate species by mapping plant-microbe interactions and predicting regulatory networks linked to a particular phenotype, 2) pragmatic and predictable improvement of microbial phenotypes through intra-species crossing of regulatory networks and gene clusters within a microbe's genome, and 3) screening and selection of new microbial genotypes that produce desired crop phenotypes.

To systematically assess the improvement of strains, a model is created that links colonization dynamics of the microbial community to genetic activity by key species. The model is used to predict genetic targets for non-intergeneric genetic remodeling (i.e. engineering the genetic architecture of the microbe in a non-transgenic fashion). See, FIG. 1A for a graphical representation of an embodiment of the process.

As illustrated in FIG. 1A, rational improvement of the crop microbiome may be used to increase soil biodiversity, tune impact of keystone species, and/or alter timing and expression of important metabolic pathways.

To this end, the inventors have developed a platform to identify and improve the role of strains within the crop microbiome. In some aspects, the inventors call this process microbial breeding.

The aforementioned "Guided Microbial Remodeling" process will be further elaborated upon in the Examples, for instance in Example 1, entitled: "Guided Microbial Remodeling-A Platform for the Rational Improvement of Microbial Species for Agriculture."

Serial Passage

Production of bacteria to improve plant traits (e.g., nitrogen fixation) can be achieved through serial passage. The production of these bacteria can be done by selecting plants, which have a particular improved trait that is influenced by the microbial flora, in addition to identifying bacteria and/or compositions that are capable of imparting one or more improved traits to one or more plants. One method of producing a bacteria to improve a plant trait includes the steps of: (a) isolating bacteria from tissue or soil of a first plant; (b) introducing a genetic variation into one or more of the bacteria to produce one or more variant bacteria; (c) exposing a plurality of plants to the variant bacteria; (d) isolating bacteria from tissue or soil of one of the plurality of plants, wherein the plant from which the bacteria is isolated has an improved trait relative to other plants in the plurality of plants; and (e) repeating steps (b) to (d) with bacteria isolated from the plant with an improved trait (step (d)). Steps (b) to (d) can be repeated any number of times (e.g., once, twice, three times, four times, five times, ten times, or more) until the improved trait in a plant reaches a desired level. Further, the plurality of plants can be more than two plants, such as 10 to 20 plants, or 20 or more, 50 or more, 100 or more, 300 or more, 500 or more, or 1000 or more plants.

In addition to obtaining a plant with an improved trait, a bacterial population comprising bacteria comprising one or more genetic variations introduced into one or more genes (e.g., genes regulating nitrogen fixation) is obtained. By repeating the steps described above, a population of bacteria can be obtained that include the most appropriate members of the population that correlate with a plant trait of interest. The bacteria in this population can be identified and their beneficial properties determined, such as by genetic and/or phenotypic analysis. Genetic analysis may occur of isolated bacteria in step (a). Phenotypic and/or genotypic information may be obtained using techniques including: high through-put screening of chemical components of plant origin, sequencing techniques including high throughput sequencing of genetic material, differential display techniques (including DDRT-PCR, and DD-PCR), nucleic acid microarray techniques, RNA-sequencing (Whole Transcriptome Shotgun Sequencing), and qRT-PCR (quantitative real time PCR). Information gained can be used to obtain community profiling information on the identity and activity of bacteria present, such as phylogenetic analysis or microarray-based screening of nucleic acids coding for components of rRNA operons or other taxonomically informative loci. Examples of taxonomically informative loci include 16S rRNA gene, 23S rRNA gene, 5S rRNA gene, 5.8S rRNA gene, 12S rRNA gene, 18S rRNA gene, 28S rRNA gene, gyrB gene, rpoB gene, fusA gene, recA gene, coxl gene, nifD gene. Example processes of taxonomic profiling to determine taxa present in a population are described in US20140155283. Bacterial identification may comprise characterizing activity of one or more genes or one or more signaling pathways, such as genes associated with the nitrogen fixation pathway. Synergistic interactions (where two components, by virtue of their combination, increase a desired effect by more than an additive amount) between different bacterial species may also be present in the bacterial populations.

Genetic Variation—Locations and Sources of Genomic Alteration

The genetic variation may be a variation in a gene selected from the group consisting of: nifA, nifL, ntrB, ntrC, glnA, glnB, glnK, draT, amtB, glnD, glnE, nifJ, nifH, nifD, nifK, nifY, nifE, nifN, nifU, nifS, nifV, nifW, nifZ, nifM, nifF, nifB, and nifQ. The genetic variation may be a variation in a gene encoding a protein with functionality selected from the group consisting of: glutamine synthetase, glutaminase, glutamine synthetase adenylyltransferase, transcriptional activator, anti-transcriptional activator, pyruvate flavodoxin oxidoreductase, flavodoxin, or NAD+-dinitrogen-reductase aDP-D-ribosyltransferase. The genetic variation may be a mutation that results in one or more of: increased expression or activity of NifA or glutaminase; decreased expression or activity of NifL, NtrB, glutamine synthetase, GlnB, GlnK, DraT, AmtB; decreased adenylyl-removing activity of GlnE; or decreased uridylyl-removing activity of GlnD. The genetic variation may be a variation in a gene selected from the group consisting of: bcsii, bcsiii, yjbE, fhaB, pehA, otsB, treZ, glsA2, and combinations thereof. In some embodiments, a genetic variation may be a variation in any of the genes described throughout this disclosure.

Introducing a genetic variation may comprise insertion and/or deletion of one or more nucleotides at a target site, such as 1, 2, 3, 4, 5, 10, 25, 50, 100, 250, 500, or more nucleotides. The genetic variation introduced into one or more bacteria of the methods disclosed herein may be a knock-out mutation (e.g. deletion of a promoter, insertion or deletion to produce a premature stop codon, deletion of an entire gene), or it may be elimination or abolishment of activity of a protein domain (e.g. point mutation affecting an active site, or deletion of a portion of a gene encoding the relevant portion of the protein product), or it may alter or abolish a regulatory sequence of a target gene. One or more regulatory sequences may also be inserted, including heterologous regulatory sequences and regulatory sequences found within a genome of a bacterial species or genus corresponding to the bacteria into which the genetic variation is introduced. Moreover, regulatory sequences may be selected based on the expression level of a gene in a bacterial culture or within a plant tissue. The genetic variation may be a pre-determined genetic variation that is specifically introduced to a target site. The genetic variation may be a random mutation within the target site. The genetic variation may be an insertion or deletion of one or more nucleotides. In some cases, a plurality of different genetic variations (e.g. 2, 3, 4, 5, 10, or more) are introduced into one or more of the isolated bacteria before exposing the bacteria to plants for assessing trait improvement. The plurality of genetic variations can be any of the above types, the same or different types, and in any combination. In some cases, a plurality of different genetic variations are introduced serially, introducing a first genetic variation after a first isolation step, a second genetic variation after a second isolation step, and so forth so as to accumulate a plurality of genetic variations in bacteria imparting progressively improved traits on the associated plants.

Genetic Variation—Methods of Introducing Genomic Alteration

In general, the term "genetic variation" refers to any change introduced into a polynucleotide sequence relative to a reference polynucleotide, such as a reference genome or portion thereof, or reference gene or portion thereof. A genetic variation may be referred to as a "mutation," and a sequence or organism comprising a genetic variation may be referred to as a "genetic variant" or "mutant". Genetic variations can have any number of effects, such as the increase or decrease of some biological activity, including gene expression, metabolism, and cell signaling. Genetic variations can be specifically introduced to a target site, or introduced randomly. A variety of molecular tools and methods are available for introducing genetic variation. For example, genetic variation can be introduced via polymerase chain reaction mutagenesis, oligonucleotide-directed mutagenesis, saturation mutagenesis, fragment shuffling mutagenesis, homologous recombination, recombineering, lambda red mediated recombination, CRISPR/Cas9 systems, chemical mutagenesis, and combinations thereof. Chemical methods of introducing genetic variation include exposure of DNA to a chemical mutagen, e.g., ethyl methanesulfonate (EMS), methyl methanesulfonate (MMS), N-nitrosourea (EN U), N-methyl-N-nitro-N'-nitrosoguanidine, 4-nitroquinoline N-oxide, diethylsulfate, benzopyrene, cyclophosphamide, bleomycin, triethylmelamine, acrylamide monomer, nitrogen mustard, vincristine, diepoxyalkanes (for example, diepoxybutane), ICR-170, formaldehyde, procarbazine hydrochloride, ethylene oxide, dimethylnitrosamine, 7,12 dimethylbenz(a)anthracene, chlorambucil, hexamethylphosphoramide, bisulfan, and the like. Radiation mutation-inducing agents include ultraviolet radiation, γ-irradiation, X-rays, and fast neutron bombardment. Genetic variation can also be introduced into a nucleic acid using, e.g., trimethylpsoralen with ultraviolet light. Random or targeted insertion of a mobile DNA element, e.g., a transposable element, is another suitable method for generating genetic variation. Genetic variations can be introduced into a nucleic acid during amplification in a cell-free in vitro system, e.g., using a polymerase chain reaction (PCR) technique such as error-prone PCR. Genetic variations can be introduced into a nucleic acid in vitro using DNA shuffling techniques (e.g., exon shuffling, domain swapping, and the like). Genetic variations can also be introduced into a nucleic acid as a result of a deficiency in a DNA repair enzyme in a cell, e.g., the presence in a cell of a mutant gene encoding a mutant DNA repair enzyme is expected to generate a high frequency of mutations (i.e., about 1 mutation/100 genes-1 mutation/10,000 genes) in the genome of the cell. Examples of genes encoding DNA repair enzymes include but are not limited to Mut H, Mut S, Mut L, and Mut U, and the homologs thereof in other species (e.g., MSH 1 6, PMS 1 2, MLH 1, GTBP, ERCC-1, and the like). Example descriptions of various methods for introducing genetic variations are provided in e.g., Stemple (2004) Nature 5:1-7; Chiang et al. (1993) PCR Methods Appl 2 (3): 210-217; Stemmer (1994) Proc. Natl. Acad. Sci. USA 91:10747-10751; and U.S. Pat. Nos. 6,033,861, and 6,773,900.

Genetic variations introduced into microbes may be classified as transgenic, cisgenic, intragenomic, intrageneric, intergeneric, synthetic, evolved, rearranged, or SNPs.

Genetic variation may be introduced into numerous metabolic pathways within microbes to elicit improvements in the traits described above. Representative pathways include sulfur uptake pathways, glycogen biosynthesis, the glutamine regulation pathway, the molybdenum uptake pathway, the nitrogen fixation pathway, ammonia assimilation, ammonia excretion or secretion, Nitrogen uptake, glutamine biosynthesis, annamox, phosphate solubilization, organic acid transport, organic acid production, agglutinins production, reactive oxygen radical scavenging genes, Indole Acetic Acid biosynthesis, trehalose biosynthesis, plant cell wall degrading enzymes or pathways, root attachment genes, exopolysaccharide secretion, glutamate synthase pathway, iron uptake pathways, siderophore pathway, chitinase pathway, ACC deaminase, glutathione biosynthesis, phosphorous signaling genes, quorum quenching pathway, cytochrome pathways, hemoglobin pathway, bacterial hemoglobin-like pathway, small RNA rsmZ, rhizobitoxine biosynthesis, lapA adhesion protein, AHL quorum sensing pathway, phenazine biosynthesis, cyclic lipopeptide biosynthesis, and antibiotic production.

CRISPR/Cas9 (Clustered regularly interspaced short palindromic repeats)/CRISPR-associated (Cas) systems can be used to introduce desired mutations. CRISPR/Cas9 provide bacteria and archaea with adaptive immunity against viruses and plasmids by using CRISPR RNAs (crRNAs) to guide the silencing of invading nucleic acids. The Cas9 protein (or functional equivalent and/or variant thereof, i.e., Cas9-like protein) naturally contains DNA endonuclease activity that depends on the association of the protein with two naturally occurring or synthetic RNA molecules called crRNA and tracrRNA (also called guide RNAs). In some cases, the two molecules are covalently link to form a single molecule (also called a single guide RNA ("sgRNA")). Thus, the Cas9 or Cas9-like protein associates with a DNA-targeting RNA (which term encompasses both the two-molecule guide RNA configuration and the single-molecule guide RNA configuration), which activates the Cas9 or Cas9-like protein and guides the protein to a target nucleic acid sequence. If the Cas9 or Cas9-like protein retains its natural enzymatic function, it will cleave target DNA to create a double-stranded break, which can lead to genome alteration (i.e., editing, deletion, insertion (when a donor polynucleotide is present), replacement, etc.), thereby altering gene expression. Some variants of Cas9 (which variants are encompassed by the term Cas9-like) have been altered such that they have a decreased DNA cleaving activity (in some cases, they cleave a single strand instead of both strands of the target DNA, while in other cases, they have severely reduced to no DNA cleavage activity). Further exemplary descriptions of CRISPR systems for introducing genetic variation can be found in, e.g. U.S. Pat. No. 8,795,965.

As a cyclic amplification technique, polymerase chain reaction (PCR) mutagenesis uses mutagenic primers to introduce desired mutations. PCR is performed by cycles of denaturation, annealing, and extension. After amplification by PCR, selection of mutated DNA and removal of parental plasmid DNA can be accomplished by: 1) replacement of dCTP by hydroxymethylated-dCTP during PCR, followed by digestion with restriction enzymes to remove non-hydroxymethylated parent DNA only; 2) simultaneous mutagenesis of both an antibiotic resistance gene and the studied gene changing the plasmid to a different antibiotic resistance, the new antibiotic resistance facilitating the selection of the desired mutation thereafter; 3) after introducing a desired mutation, digestion of the parent methylated template DNA by restriction enzyme Dpnl which cleaves only methylated DNA, by which the mutagenized unmethylated chains are recovered; or 4) circularization of the mutated PCR products in an additional ligation reaction to increase the transformation efficiency of mutated DNA. Further description of exemplary methods can be found in e.g. U.S. Pat. Nos. 7,132,265, 6,713,285, 6,673,610, 6,391,548, 5,789,166, 5,780,270, 5,354,670, 5,071,743, and US20100267147.

Oligonucleotide-directed mutagenesis, also called site-directed mutagenesis, typically utilizes a synthetic DNA primer. This synthetic primer contains the desired mutation and is complementary to the template DNA around the mutation site so that it can hybridize with the DNA in the gene of interest. The mutation may be a single base change (a point mutation), multiple base changes, deletion, or insertion, or a combination of these. The single-strand primer is then extended using a DNA polymerase, which copies the rest of the gene. The gene thus copied contains the mutated site, and may then be introduced into a host cell as a vector and cloned. Finally, mutants can be selected by DNA sequencing to check that they contain the desired mutation.

Genetic variations can be introduced using error-prone PCR. In this technique, the gene of interest is amplified using a DNA polymerase under conditions that are deficient in the fidelity of replication of sequence. The result is that the amplification products contain at least one error in the sequence. When a gene is amplified and the resulting product(s) of the reaction contain one or more alterations in sequence when compared to the template molecule, the resulting products are mutagenized as compared to the template. Another means of introducing random mutations is exposing cells to a chemical mutagen, such as nitrosoguanidine or ethyl methanesulfonate (Nestmann, Mutat Res 1975 June; 28 (3): 323-30), and the vector containing the gene is then isolated from the host.

Saturation mutagenesis is another form of random mutagenesis, in which one tries to generate all or nearly all possible mutations at a specific site, or narrow region of a gene. In a general sense, saturation mutagenesis is comprised of mutagenizing a complete set of mutagenic cassettes (wherein each cassette is, for example, 1-500 bases in length) in defined polynucleotide sequence to be mutagenized (wherein the sequence to be mutagenized is, for example, from 15 to 100,000 bases in length). Therefore, a group of mutations (e.g. ranging from 1 to 100 mutations) is introduced into each cassette to be mutagenized. A grouping of mutations to be introduced into one cassette can be different or the same from a second grouping of mutations to be introduced into a second cassette during the application of one round of saturation mutagenesis. Such groupings are exemplified by deletions, additions, groupings of particular codons, and groupings of particular nucleotide cassettes.

Fragment shuffling mutagenesis, also called DNA shuffling, is a way to rapidly propagate beneficial mutations. In an example of a shuffling process, DNAse is used to fragment a set of parent genes into pieces of e.g. about 50-100 bp in length. This is then followed by a polymerase chain reaction (PCR) without primers—DNA fragments with sufficient overlapping homologous sequence will anneal to each other and are then be extended by DNA polymerase. Several rounds of this PCR extension are allowed to occur, after some of the DNA molecules reach the size of the parental genes. These genes can then be amplified with another PCR, this time with the addition of primers that are designed to complement the ends of the strands. The primers may have additional sequences added to their 5' ends, such as sequences for restriction enzyme recognition sites needed for ligation into a cloning vector. Further examples of shuffling techniques are provided in US20050266541.

Homologous recombination mutagenesis involves recombination between an exogenous DNA fragment and the targeted polynucleotide sequence. After a double-stranded break occurs, sections of DNA around the 5' ends of the break are cut away in a process called resection. In the strand invasion step that follows, an overhanging 3' end of the broken DNA molecule then "invades" a similar or identical DNA molecule that is not broken. The method can be used to delete a gene, remove exons, add a gene, and introduce point mutations. Homologous recombination mutagenesis can be permanent or conditional. Typically, a recombination template is also provided. A recombination template may be a component of another vector, contained in a separate vector, or provided as a separate polynucleotide. In some embodiments, a recombination template is designed to serve as a template in homologous recombination, such as within or near a target sequence nicked or cleaved by a site-specific nuclease. A template polynucleotide may be of any suitable length, such as about or more than about 10, 15, 20, 25, 50, 75, 100, 150, 200, 500, 1000, or more nucleotides in length. In some embodiments, the template polynucleotide is complementary to a portion of a polynucleotide comprising the target sequence. When optimally aligned, a template polynucleotide might overlap with one or more nucleotides of a target sequences (e.g. about or more than about 1, 5, 10, 15, 20, 25, 30, 35, 40, 45, 50, 60, 70, 80, 90, 100 or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence. Non-limiting examples of site-directed nucleases useful in methods of homologous recombination include zinc finger nucleases, CRISPR nucleases, TALE nucleases, and meganuclease. For a further description of the use of such nucleases, see e.g. U.S. Pat. No. 8,795,965 and US20140301990.

Mutagens that create primarily point mutations and short deletions, insertions, transversions, and/or transitions, including chemical mutagens or radiation, may be used to create genetic variations. Mutagens include, but are not limited to, ethyl methanesulfonate, methylmethane sulfonate, N-ethyl-N-nitrosourea, triethylmelamine, N-methyl-N-nitrosourea, procarbazine, chlorambucil, cyclophosphamide, diethyl sulfate, acrylamide monomer, melphalan, nitrogen mustard, vincristine, dimethylnitrosamine, N-methyl-N'-nitro-Nitrosoguanidine, nitrosoguanidine, 2-aminopurine, 7,12 dimethyl-benz (a) anthracene, ethylene oxide, hexamethylphosphoramide, bisulfan, diepoxyalkanes (diepoxyoctane, diepoxybutane, and the like), 2-methoxy-6-chloro-9 [3-(ethyl-2-chloro-ethyl)aminopropylamino]acridine dihydrochloride and formaldehyde.

Introducing genetic variation may be an incomplete process, such that some bacteria in a treated population of bacteria carry a desired mutation while others do not. In some cases, it is desirable to apply a selection pressure so as to enrich for bacteria carrying a desired genetic variation. Traditionally, selection for successful genetic variants involved selection for or against some functionality imparted or abolished by the genetic variation, such as in the case of inserting antibiotic resistance gene or abolishing a metabolic activity capable of converting a non-lethal compound into a lethal metabolite. It is also possible to apply a selection pressure based on a polynucleotide sequence itself, such that only a desired genetic variation need be introduced (e.g. without also requiring a selectable marker). In this case, the selection pressure can comprise cleaving genomes lacking the genetic variation introduced to a target site, such that selection is effectively directed against the reference sequence into which the genetic variation is sought to be introduced. Typically, cleavage occurs within 100 nucleotides of the target site (e.g. within 75, 50, 25, 10, or fewer nucleotides from the target site, including cleavage at or within the target site). Cleaving may be directed by a site-specific nuclease selected from the group consisting of a Zinc Finger nuclease, a CRISPR nuclease, a TALE nuclease (TALEN), and a meganuclease. Such a process is similar to processes for enhancing homologous recombination at a target site, except that no template for homologous recombination is provided. As a result, bacteria lacking the desired genetic variation are more likely to undergo cleavage that, left unrepaired, results in cell death. Bacteria surviving selection may then be isolated for use in exposing to plants for assessing conferral of an improved trait.

A CRISPR nuclease may be used as the site-specific nuclease to direct cleavage to a target site. An improved selection of mutated microbes can be obtained by using Cas9 to kill non-mutated cells. Plants are then inoculated with the mutated microbes to re-confirm symbiosis and create evolutionary pressure to select for efficient symbionts. Microbes can then be re-isolated from plant tissues. CRISPR nuclease systems employed for selection against non-variants can employ similar elements to those described above with respect to introducing genetic variation, except that no template for homologous recombination is provided. Cleavage directed to the target site thus enhances death of affected cells.

Other options for specifically inducing cleavage at a target site are available, such as zinc finger nucleases, TALE nuclease (TALEN) systems, and meganuclease. Zinc-finger nucleases (ZFNs) are artificial DNA endonucleases generated by fusing a zinc finger DNA binding domain to a DNA cleavage domain. ZFNs can be engineered to target desired DNA sequences and this enables zinc-finger nucleases to cleave unique target sequences. When introduced into a cell, ZFNs can be used to edit target DNA in the cell (e.g., the cell's genome) by inducing double stranded breaks. Transcription activator-like effector nucleases (TALENs) are artificial DNA endonucleases generated by fusing a TAL (Transcription activator-like) effector DNA binding domain to a DNA cleavage domain. TALENS can be quickly engineered to bind practically any desired DNA sequence and when introduced into a cell, TALENs can be used to edit target DNA in the cell (e.g., the cell's genome) by inducing double strand breaks. Meganucleases (homing endonuclease) are endodeoxyribonucleases characterized by a large recognition site (double-stranded DNA sequences of 12 to 40 base pairs. Meganucleases can be used to replace, eliminate or modify sequences in a highly targeted way. By modifying their recognition sequence through protein engineering, the targeted sequence can be changed. Meganucleases can be used to modify all genome types, whether bacterial, plant or animal and are commonly grouped into four families: the LAGLIDADG family (SEQ ID NO: 1), the GIY-YIG family, the His-Cyst box family and the HNH family. Exemplary homing endonucleases include I-SceI, I-CeuI, PI-PspI, PI-Sce, I-SceIV, I-CsmI, I-PanI, I-SceII, I-PpoI, I-SceIII, I-CreI, I-TevI, I-TevII and I-TevIII.

Genetic Variation—Methods of Identification

The microbes of the present disclosure may be identified by one or more genetic modifications or alterations, which have been introduced into said microbe. One method by which said genetic modification or alteration can be identified is via reference to a SEQ ID NO that contains a portion of the microbe's genomic sequence that is sufficient to identify the genetic modification or alteration.

Further, in the case of microbes that have not had a genetic modification or alteration (e.g. a wild type, WT) introduced into their genomes, the disclosure can utilize 16S nucleic acid sequences to identify said microbes. A 16S nucleic acid sequence is an example of a "molecular marker" or "genetic marker," which refers to an indicator that is used in methods for visualizing differences in characteristics of nucleic acid sequences. Examples of other such indicators are restriction fragment length polymorphism (RFLP) markers, amplified fragment length polymorphism (AFLP) markers, single nucleotide polymorphisms (SNPs), insertion mutations, microsatellite markers (SSRs), sequence-characterized amplified regions (SCARs), cleaved amplified polymorphic sequence (CAPS) markers or isozyme markers or combinations of the markers described herein which defines a specific genetic and chromosomal location. Markers further include polynucleotide sequences encoding 16S or 18S rRNA, and internal transcribed spacer (ITS) sequences, which are sequences found between small-subunit and large-subunit rRNA genes that have proven to be especially useful in elucidating relationships or distinctions when compared against one another. Furthermore, the disclosure utilizes unique sequences found in genes of interest (e.g. nifH,D,K,L,A, glnE, amtB, etc.) to identify microbes disclosed herein.

The primary structure of major rRNA subunit 16S comprise a particular combination of conserved, variable, and hypervariable regions that evolve at different rates and enable the resolution of both very ancient lineages such as domains, and more modern lineages such as genera. The secondary structure of the 16S subunit include approximately 50 helices which result in base pairing of about 67% of the residues. These highly conserved secondary structural features are of great functional importance and can be used to ensure positional homology in multiple sequence alignments and phylogenetic analysis. Over the previous few decades, the 16S rRNA gene has become the most sequenced taxonomic marker and is the cornerstone for the current systematic classification of bacteria and archaea (Yarza et al. 2014. *Nature Rev. Micro.* 12:635-45).

Thus, in certain aspects, the disclosure provides for a sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to any sequence in Tables 23, 24, 30, 31, and 32.

Thus, in certain aspects, the disclosure provides for a microbe that comprises a sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 62-303. These sequences and their associated descriptions can be found in Tables 31 and 32.

In some aspects, the disclosure provides for a microbe that comprises a 16S nucleic acid sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 85, 96, 111, 121, 122, 123, 124, 136, 149, 157, 167, 261, 262, 269, 277-283. These sequences and their associated descriptions can be found in Table 32.

In some aspects, the disclosure provides for a microbe that comprises a nucleic acid sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 86-95, 97-110, 112-120, 125-135, 137-148, 150-156, 158-166, 168-176, 263-268, 270-274, 275, 276, 284-295. These sequences and their associated descriptions can be found in Table 32.

In some aspects, the disclosure provides for a microbe that comprises a nucleic acid sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 177-260, 296-303. These sequences and their associated descriptions can be found in Table 32.

In some aspects, the disclosure provides for a microbe that comprises, or primer that comprises, or probe that comprises, or non-native junction sequence that comprises, a nucleic acid sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 304-424. These sequences and their associated descriptions can be found in Table 30.

In some aspects, the disclosure provides for a microbe that comprises a non-native junction sequence that shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 372-405. These sequences and their associated descriptions can be found in Table 30.

In some aspects, the disclosure provides for a microbe that comprises an amino acid sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 77, 78, 81, 82, or 83. These sequences and their associated descriptions can be found in Table 31.

Genetic Variation—Methods of Detection: Primers, Probes, and Assays

The present disclosure teaches primers, probes, and assays that are useful for detecting the microbes taught herein. In some aspects, the disclosure provides for methods of detecting the WT parental strains. In other aspects, the disclosure provides for methods of detecting the non-intergeneric engineered microbes derived from the WT strains. In aspects, the present disclosure provides methods of identifying non-intergeneric genetic alterations in a microbe.

In aspects, the genomic engineering methods of the present disclosure lead to the creation of non-natural nucleotide "junction" sequences in the derived non-intergeneric microbes. These non-naturally occurring nucleotide junctions can be used as a type of diagnostic that is indicative of the presence of a particular genetic alteration in a microbe taught herein.

The present techniques are able to detect these non-naturally occurring nucleotide junctions via the utilization of specialized quantitative PCR methods, including uniquely designed primers and probes. In some aspects, the probes of the disclosure bind to the non-naturally occurring nucleotide junction sequences. In some aspects, traditional PCR is utilized. In other aspects, real-time PCR is utilized. In some aspects, quantitative PCR (qPCR) is utilized.

Thus, the disclosure can cover the utilization of two common methods for the detection of PCR products in real-time: (1) non-specific fluorescent dyes that intercalate with any double-stranded DNA, and (2) sequence-specific DNA probes consisting of oligonucleotides that are labelled with a fluorescent reporter which permits detection only after hybridization of the probe with its complementary sequence. In some aspects, only the non-naturally occurring nucleotide junction will be amplified via the taught primers, and consequently can be detected via either a non-specific dye, or via the utilization of a specific hybridization probe. In other aspects, the primers of the disclosure are chosen such that the primers flank either side of a junction sequence, such that if an amplification reaction occurs, then said junction sequence is present.

Aspects of the disclosure involve non-naturally occurring nucleotide junction sequence molecules per se, along with other nucleotide molecules that are capable of binding to said non-naturally occurring nucleotide junction sequences under mild to stringent hybridization conditions. In some aspects, the nucleotide molecules that are capable of binding to said non-naturally occurring nucleotide junction sequences under mild to stringent hybridization conditions are termed "nucleotide probes."

In aspects, genomic DNA can be extracted from samples and used to quantify the presence of microbes of the disclosure by using qPCR. The primers utilized in the qPCR reaction can be primers designed by Primer Blast (www.ncbi.nlm.nih.gov/tools/primer-blast/) to amplify unique regions of the wild-type genome or unique regions of the engineered non-intergeneric mutant strains. The qPCR reaction can be carried out using the SYBR GreenER qPCR SuperMix Universal (Thermo Fisher P/N 11762100) kit, using only forward and reverse amplification primers; alternatively, the Kapa Probe Force kit (Kapa Biosystems P/N KK4301) can be used with amplification primers and a TaqMan probe containing a FAM dye label at the 5' end, an internal ZEN quencher, and a minor groove binder and fluorescent quencher at the 3' end (Integrated DNA Technologies).

Certain primer, probe, and non-native junction sequences are listed in Table 30. qPCR reaction efficiency can be measured using a standard curve generated from a known quantity of gDNA from the target genome. Data can be normalized to genome copies per g fresh weight using the tissue weight and extraction volume.

Quantitative polymerase chain reaction (qPCR) is a method of quantifying, in real time, the amplification of one or more nucleic acid sequences. The real time quantification of the PCR assay permits determination of the quantity of nucleic acids being generated by the PCR amplification steps by comparing the amplifying nucleic acids of interest and an appropriate control nucleic acid sequence, which may act as a calibration standard.

TaqMan probes are often utilized in qPCR assays that require an increased specificity for quantifying target nucleic acid sequences. TaqMan probes comprise an oligonucleotide probe with a fluorophore attached to the 5' end and a quencher attached to the 3' end of the probe. When the TaqMan probes remain as is with the 5' and 3' ends of the probe in close contact with each other, the quencher prevents fluorescent signal transmission from the fluorophore. TaqMan probes are designed to anneal within a nucleic acid region amplified by a specific set of primers. As the Taq polymerase extends the primer and synthesizes the nascent strand, the 5' to 3' exonuclease activity of the Taq polymerase degrades the probe that annealed to the template. This probe degradation releases the fluorophore, thus breaking the close proximity to the quencher and allowing fluorescence of the fluorophore. Fluorescence detected in the qPCR assay is directly proportional to the fluorophore released and the amount of DNA template present in the reaction.

The features of qPCR allow the practitioner to eliminate the labor-intensive post-amplification step of gel electrophoresis preparation, which is generally required for observation of the amplified products of traditional PCR assays. The benefits of qPCR over conventional PCR are considerable, and include increased speed, ease of use, reproducibility, and quantitative ability.

Improvement of Traits

Methods of the present disclosure may be employed to introduce or improve one or more of a variety of desirable traits. Examples of traits that may introduced or improved include: root biomass, root length, height, shoot length, leaf number, water use efficiency, overall biomass, yield, fruit size, grain size, photosynthesis rate, tolerance to drought, heat tolerance, salt tolerance, resistance to nematode stress, resistance to a fungal pathogen, resistance to a bacterial pathogen, resistance to a viral pathogen, level of a metabolite, and proteome expression. The desirable traits, including height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof, can be used to measure growth, and compared with the growth rate of reference agricultural plants (e.g., plants without the improved traits) grown under identical conditions.

A preferred trait to be introduced or improved is nitrogen fixation, as described herein. In some cases, a plant resulting from the methods described herein exhibits a difference in the trait that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least 100%, at least about 200%, at least about 300%, at least about 400% or greater than a reference agricultural plant grown under the same conditions in the soil. In additional examples, a plant resulting from the methods described herein exhibits a difference in the trait that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least 100%, at least about 200%, at least about 300%, at least about 400% or greater than a reference agricultural plant grown under similar conditions in the soil.

The trait to be improved may be assessed under conditions including the application of one or more biotic or abiotic stressors. Examples of stressors include abiotic stresses (such as heat stress, salt stress, drought stress, cold stress, and low nutrient stress) and biotic stresses (such as nematode stress, insect herbivory stress, fungal pathogen stress, bacterial pathogen stress, and viral pathogen stress).

The trait improved by methods and compositions of the present disclosure may be nitrogen fixation, including in a plant not previously capable of nitrogen fixation. In some cases, bacteria isolated according to a method described herein produce 1% or more (e.g. 2%, 3%, 4%, 5%, 6%, 7%, 8%, 9%, 10%, 15%, 20%, or more) of a plant's nitrogen, which may represent an increase in nitrogen fixation capability of at least 2-fold (e.g. 3-fold, 4-fold, 5-fold, 6-fold, 7-fold, 8-fold, 9-fold, 10-fold, 20-fold, 50-fold, 100-fold, 1000-fold, or more) as compared to bacteria isolated from the first plant before introducing any genetic variation. In some cases, the bacteria produce 5% or more of a plant's nitrogen. The desired level of nitrogen fixation may be achieved after repeating the steps of introducing genetic variation, exposure to a plurality of plants, and isolating bacteria from plants with an improved trait one or more times (e.g. 1, 2, 3, 4, 5, 10, 15, 25, or more times). In some cases, enhanced levels of nitrogen fixation are achieved in the presence of fertilizer supplemented with glutamine, ammonia, or other chemical source of nitrogen. Methods for assessing degree of nitrogen fixation are known, examples of which are described herein.

Microbe breeding is a method to systematically identify and improve the role of species within the crop microbiome. The method comprises three steps: 1) selection of candidate species by mapping plant-microbe interactions and predicting regulatory networks linked to a particular phenotype, 2) pragmatic and predictable improvement of microbial phenotypes through intra-species crossing of regulatory networks and gene clusters, and 3) screening and selection of new microbial genotypes that produce desired crop phenotypes. To systematically assess the improvement of strains, a model is created that links colonization dynamics of the microbial community to genetic activity by key species. The model is used to predict genetic targets for breeding and improve the frequency of selecting improvements in micro-biome-encoded traits of agronomic relevance.

Measuring Nitrogen Delivered in an Agriculturally Relevant Field Context

In the field, the amount of nitrogen delivered can be determined by the function of colonization multiplied by the activity.

$$\text{Nitrogen delivered} = \int_{Time\ \&\ Space} \text{Colonization} \times \text{Activity}$$

The above equation requires (1) the average colonization per unit of plant tissue, and (2) the activity as either the amount of nitrogen fixed or the amount of ammonia excreted by each microbial cell. To convert to pounds of nitrogen per acre, corn growth physiology is tracked over time, e.g., size of the plant and associated root system throughout the maturity stages.

The pounds of nitrogen delivered to a crop per acre-season can be calculated by the following equation:

$$\text{Nitrogen delivered} = \int \text{Plant Tissue}(t) \times \text{Colonization}(t) \times \text{Activity}(t) dt$$

The Plant Tissue (t) is the fresh weight of corn plant tissue over the growing time (t). Values for reasonably making the calculation are described in detail in the publication entitled Roots, Growth and Nutrient Uptake (Mengel. Dept. of Agronomy Pub. #AGRY-95-08 (Rev. May 1995. p. 1-8).

The Colonization (t) is the amount of the microbes of interest found within the plant tissue, per gram fresh weight of plant tissue, at any particular time, t, during the growing season. In the instance of only a single timepoint available, the single timepoint is normalized as the peak colonization rate over the season, and the colonization rate of the remaining timepoints are adjusted accordingly.

Activity (t) is the rate of which N is fixed by the microbes of interest per unit time, at any particular time, t, during the growing season. In the embodiments disclosed herein, this activity rate is approximated by in vitro acetylene reduction assay (ARA) in ARA media in the presence of 5 mM glutamine or Ammonium excretion assay in ARA media in the presence of 5 mM ammonium ions.

The Nitrogen delivered amount is then calculated by numerically integrating the above function. In cases where the values of the variables described above are discretely measured at set timepoints, the values in between those timepoints are approximated by performing linear interpolation.

Nitrogen Fixation

Described herein are methods of increasing nitrogen fixation in a plant, comprising exposing the plant to bacteria comprising one or more genetic variations introduced into one or more genes regulating nitrogen fixation, wherein the bacteria produce 1% or more of nitrogen in the plant (e.g. 2%, 5%, 10%, or more), which may represent a nitrogen-fixation capability of at least 2-fold as compared to the plant in the absence of the bacteria. The bacteria may produce the nitrogen in the presence of fertilizer supplemented with glutamine, urea, nitrates or ammonia. Genetic variations can be any genetic variation described herein, including examples provided above, in any number and any combination. The genetic variation may be introduced into a gene selected from the group consisting of nifA, nifL, ntrB, ntrC, glutamine synthetase, glnA, glnB, glnK, draT, amtB, gluta-minase, glnD, glnE, nifJ, nifH, nifD, nifK, nifY, nifE, nifN, nifU, nifS, nifV, nifW, nifZ, nifM, nifF, nifB, and nifQ. The genetic variation may be a mutation that results in one or more of: increased expression or activity of nifA or gluta-minase; decreased expression or activity of nifL, ntrB, glutamine synthetase, glnB, glnK, draT, amtB; decreased adenylyl-removing activity of GlnE; or decreased uridylyl-removing activity of GlnD. The genetic variation introduced into one or more bacteria of the methods disclosed herein may be a knock-out mutation or it may abolish a regulatory sequence of a target gene, or it may comprise insertion of a heterologous regulatory sequence, for example, insertion of a regulatory sequence found within the genome of the same bacterial species or genus. The regulatory sequence can be chosen based on the expression level of a gene in a bacterial culture or within plant tissue. The genetic variation may be produced by chemical mutagenesis. The plants grown in step (c) may be exposed to biotic or abiotic stressors.

The amount of nitrogen fixation that occurs in the plants described herein may be measured in several ways, for example by an acetylene-reduction (AR) assay. An acety-lene-reduction assay can be performed in vitro or in vivo. Evidence that a particular bacterium is providing fixed nitrogen to a plant can include: 1) total plant N significantly increases upon inoculation, preferably with a concomitant increase in N concentration in the plant; 2) nitrogen defi-ciency symptoms are relieved under N-limiting conditions upon inoculation (which should include an increase in dry matter); 3) $N_2$ fixation is documented through the use of an $^{15}N$ approach (which can be isotope dilution experiments, $15N_2$ reduction assays, or $^{15}N$ natural abundance assays); 4) fixed N is incorporated into a plant protein or metabolite; and 5) all of these effects are not be seen in non-inoculated plants or in plants inoculated with a mutant of the inoculum strain.

The wild-type nitrogen fixation regulatory cascade can be represented as a digital logic circuit where the inputs $O_2$ and $NH_4^+$ pass through a NOR gate, the output of which enters an AND gate in addition to ATP. In some embodiments, the methods disclosed herein disrupt the influence of $NH_4^+$ on this circuit, at multiple points in the regulatory cascade, so that microbes can produce nitrogen even in fertilized fields. However, the methods disclosed herein also envision alter-ing the impact of ATP or $O_2$ on the circuitry, or replacing the circuitry with other regulatory cascades in the cell, or altering genetic circuits other than nitrogen fixation. Gene clusters can be re-engineered to generate functional products under the control of a heterologous regulatory system. By eliminating native regulatory elements outside of, and within, coding sequences of gene clusters, and replacing them with alternative regulatory systems, the functional products of complex genetic operons and other gene clusters can be controlled and/or moved to heterologous cells, including cells of different species other than the species from which the native genes were derived. Once re-engi-neered, the synthetic gene clusters can be controlled by genetic circuits or other inducible regulatory systems, thereby controlling the products' expression as desired. The expression cassettes can be designed to act as logic gates, pulse generators, oscillators, switches, or memory devices. The controlling expression cassette can be linked to a promoter such that the expression cassette functions as an environmental sensor, such as an oxygen, temperature, touch, osmotic stress, membrane stress, or redox sensor.

As an example, the nifL, nifA, nifT, and nifX genes can be eliminated from the nif gene cluster. Synthetic genes can be designed by codon randomizing the DNA encoding each amino acid sequence. Codon selection is performed, specifying that codon usage be as divergent as possible from the codon usage in the native gene. Proposed sequences are scanned for any undesired features, such as restriction enzyme recognition sites, transposon recognition sites, repetitive sequences, sigma 54 and sigma 70 promoters, cryptic ribosome binding sites, and rho independent terminators. Synthetic ribosome binding sites are chosen to match the strength of each corresponding native ribosome binding site, such as by constructing a fluorescent reporter plasmid in which the 150 bp surrounding a gene's start codon (from −60 to +90) is fused to a fluorescent gene. This chimera can be expressed under control of the Ptac promoter, and fluorescence measured via flow cytometry. To generate synthetic ribosome binding sites, a library of reporter plasmids using 150 bp (−60 to +90) of a synthetic expression cassette is generated. Briefly, a synthetic expression cassette can consist of a random DNA spacer, a degenerate sequence encoding an RBS library, and the coding sequence for each synthetic gene. Multiple clones are screened to identify the synthetic ribosome binding site that best matched the native ribosome binding site. Synthetic operons that consist of the same genes as the native operons are thus constructed and tested for functional complementation. A further exemplary description of synthetic operons is provided in US20140329326.

Bacterial Species

Microbes useful in the methods and compositions disclosed herein may be obtained from any source. In some cases, microbes may be bacteria, archaea, protozoa or fungi. The microbes of this disclosure may be nitrogen fixing microbes, for example a nitrogen fixing bacteria, nitrogen fixing archaea, nitrogen fixing fungi, nitrogen fixing yeast, or nitrogen fixing protozoa. Microbes useful in the methods and compositions disclosed herein may be spore-forming microbes, for example spore forming bacteria. In some cases, bacteria useful in the methods and compositions disclosed herein may be Gram positive bacteria or Gram negative bacteria. In some cases, the bacteria may be an endospore forming bacteria of the Firmicute phylum. In some cases, the bacteria may be a diazotroph. In some cases, the bacteria may not be a diazotroph.

The methods and compositions of this disclosure may be used with an archaea, such as, for example, Methanothermobacter thermoautotrophicus.

In some cases, bacteria which may be useful include, but are not limited to, Agrobacterium radiobacter, Bacillus acidocaldarius, Bacillus acidoterrestris, Bacillus agri, Bacillus aizawai, Bacillus albolactis, Bacillus alcalophilus, Bacillus alvei, Bacillus aminoglucosidicus, Bacillus aminovorans, Bacillus amylolyticus (also known as Paenibacillus amylolyticus) Bacillus amyloliquefaciens, Bacillus aneurinolyticus, Bacillus atrophaeus, Bacillus azotoformans, Bacillus badius, Bacillus cereus (synonyms: Bacillus endorhythmos, Bacillus medusa), Bacillus chitinosporus, Bacillus circulans, Bacillus coagulans, Bacillus endoparasiticus Bacillus fastidiosus, Bacillus firmus, Bacillus kurstaki, Bacillus lacticola, Bacillus lactimorbus, Bacillus lactis, Bacillus laterosporus (also known as Brevibacillus laterosporus), Bacillus lautus, Bacillus lentimorbus, Bacillus lentus, Bacillus licheniformis, Bacillus maroccanus, Bacillus megaterium, Bacillus metiens, Bacillus mycoides, Bacillus natto, Bacillus nematocida, Bacillus nigrificans, Bacillus nigrum, Bacillus pantothenticus, Bacillus popillae, Bacillus psychrosaccharolyticus, Bacillus pumilus, Bacillus siamensis, Bacillus smithii, Bacillus sphaericus, Bacillus subtilis, Bacillus thuringiensis, Bacillus uniflagellatus, Bradyrhizobium japonicum, Brevibacillus brevis Brevibacillus laterosporus (formerly Bacillus laterosporus), Chromobacterium subtsugae, Delftia acidovorans, Lactobacillus acidophilus, Lysobacter antibioticus, Lysobacter enzymogenes, Paenibacillus alvei, Paenibacillus polymyxa, Paenibacillus popilliae (formerly Bacillus popilliae), Pantoea agglomerans, Pasteuria penetrans (formerly Bacillus penetrans), Pasteuria usgae, Pectobacterium carotovorum (formerly Erwinia carotovora), Pseudomonas aeruginosa, Pseudomonas aureofaciens, Pseudomonas cepacia (formerly known as Burkholderia cepacia), Pseudomonas chlororaphis, Pseudomonas fluorescens, Pseudomonas proradix, Pseudomonas putida, Pseudomonas syringae, Serratia entomophila, Serratia marcescens, Streptomyces colombiensis, Streptomyces galbus, Streptomyces goshikiensis, Streptomyces griseoviridis, Streptomyces lavendulae, Streptomyces prasinus, Streptomyces saraceticus, Streptomyces venezuelae, Xanthomonas campestris, Xenorhabdus luminescens, Xenorhabdus nematophila, Rhodococcus globerulus AQ719 (NRRL Accession No. B-21663), Bacillus sp. AQ175 (ATCC Accession No. 55608), Bacillus sp. AQ 177 (ATCC Accession No. 55609), Bacillus sp. AQ178 (ATCC Accession No. 53522), and Streptomyces sp. strain NRRL Accession No. B-30145. In some cases the bacterium may be Azotobacter chroococcum, Methanosarcina barkeri, Klebsiella pneumoniae, Azotobacter vinelandii, Rhodobacter spharoides, Rhodobacter capsulatus, Rhodobacter palustris, Rhodosporillum rubrum, Rhizobium leguminosarum or Rhizobium etli.

In some cases, the bacterium may be a species of Clostridium, for example Clostridium pasteurianum, Clostridium beijerinckii, Clostridium perfringens, Clostridium tetani, Clostridium acetobutylicum.

In some cases, bacteria used with the methods and compositions of the present disclosure may be cyanobacteria. Examples of cyanobacterial genuses include Anabaena (for example Anabaena sp. PCC7120), Nostoc (for example Nostoc punctiforme), or Synechocystis (for example Synechocystis sp. PCC6803).

In some cases, bacteria used with the methods and compositions of the present disclosure may belong to the phylum Chlorobi, for example Chlorobium tepidum.

In some cases, microbes used with the methods and compositions of the present disclosure may comprise a gene homologous to a known NifH gene. Sequences of known NifH genes may be found in, for example, the Zehr lab NifH database, (wwwzehr.pmc.ucsc.edu/nifH_Database_Public/, Apr. 4, 2014), or the Buckley lab NifH database (www.css-.cornell.edu/faculty/buckley/nifh, and Gaby, John Christian, and Daniel H. Buckley. "A comprehensive aligned nifH gene database: a multipurpose tool for studies of nitrogen-fixing bacteria." Database 2014 (2014): bau001). In some cases, microbes used with the methods and compositions of the present disclosure may comprise a sequence which encodes a polypeptide with at least 60%, 70%, 80%, 85%, 90%, 95%, 96%, 96%, 98%, 99% or more than 99% sequence identity to a sequence from the Zehr lab NifH database, (wwwzehr.pmc.ucsc.edu/nifH_Database_Public/, Apr. 4, 2014). In some cases, microbes used with the methods and compositions of the present disclosure may comprise a sequence which encodes a polypeptide with at least 60%, 70%, 80%, 85%, 90%, 95%, 96%, 96%, 98%, 99% or more than 99% sequence identity to a sequence from the Buckley lab NifH database, (Gaby, John Christian, and Daniel H. Buckley. "A comprehensive aligned nifH gene database: a multipurpose tool for studies of nitrogen-fixing bacteria." *Database* 2014 (2014): bau001).

Microbes useful in the methods and compositions disclosed herein can be obtained by extracting microbes from surfaces or tissues of native plants; grinding seeds to isolate microbes; planting seeds in diverse soil samples and recovering microbes from tissues; or inoculating plants with exogenous microbes and determining which microbes appear in plant tissues. Non-limiting examples of plant tissues include a seed, seedling, leaf, cutting, plant, bulb, tuber, root, and rhizomes. In some cases, bacteria are isolated from a seed. The parameters for processing samples may be varied to isolate different types of associative microbes, such as rhizospheric, epiphytes, or endophytes. Bacteria may also be sourced from a repository, such as environmental strain collections, instead of initially isolating from a first plant. The microbes can be genotyped and phenotyped, via sequencing the genomes of isolated microbes; profiling the composition of communities in planta; characterizing the transcriptomic functionality of communities or isolated microbes; or screening microbial features using selective or phenotypic media (e.g., nitrogen fixation or phosphate solubilization phenotypes). Selected candidate strains or populations can be obtained via sequence data; phenotype data; plant data (e.g., genome, phenotype, and/or yield data); soil data (e.g., pH, N/P/K content, and/or bulk soil biotic communities); or any combination of these.

The bacteria and methods of producing bacteria described herein may apply to bacteria able to self-propagate efficiently on the leaf surface, root surface, or inside plant tissues without inducing a damaging plant defense reaction, or bacteria that are resistant to plant defense responses. The bacteria described herein may be isolated by culturing a plant tissue extract or leaf surface wash in a medium with no added nitrogen. However, the bacteria may be unculturable, that is, not known to be culturable or difficult to culture using standard methods known in the art. The bacteria described herein may be an endophyte or an epiphyte or a bacterium inhabiting the plant rhizosphere (rhizospheric bacteria). The bacteria obtained after repeating the steps of introducing genetic variation, exposure to a plurality of plants, and isolating bacteria from plants with an improved trait one or more times (e.g. 1, 2, 3, 4, 5, 10, 15, 25, or more times) may be endophytic, epiphytic, or rhizospheric. Endophytes are organisms that enter the interior of plants without causing disease symptoms or eliciting the formation of symbiotic structures, and are of agronomic interest because they can enhance plant growth and improve the nutrition of plants (e.g., through nitrogen fixation). The bacteria can be a seed-borne endophyte. Seed-borne endophytes include bacteria associated with or derived from the seed of a grass or plant, such as a seed-borne bacterial endophyte found in mature, dry, undamaged (e.g., no cracks, visible fungal infection, or prematurely germinated) seeds. The seed-borne bacterial endophyte can be associated with or derived from the surface of the seed; alternatively, or in addition, it can be associated with or derived from the interior seed compartment (e.g., of a surface-sterilized seed). In some cases, a seed-borne bacterial endophyte is capable of replicating within the plant tissue, for example, the interior of the seed. Also, in some cases, the seed-borne bacterial endophyte is capable of surviving desiccation.

The bacterial isolated according to methods of the disclosure, or used in methods or compositions of the disclosure, can comprise a plurality of different bacterial taxa in combination. By way of example, the bacteria may include Proteobacteria (such as *Pseudomonas, Enterobacter, Stenotrophomonas, Burkholderia, Rhizobium, Herbaspirillum, Pantoea, Serratia, Rahnella, Azospirillum, Azorhizobium, Azotobacter, Duganella, Delftia, Bradyrhizobiun, Sinorhizobium* and *Halomonas*), *Firmicutes* (such as *Bacillus, Paenibacillus, Lactobacillus, Mycoplasma*, and *Acetabacterium*), and Actinobacteria (such as *Streptomyces, Rhodacoccus, Microbacterium*, and *Curtobacterium*). The bacteria used in methods and compositions of this disclosure may include nitrogen fixing bacterial consortia of two or more species. In some cases, one or more bacterial species of the bacterial consortia may be capable of fixing nitrogen. In some cases, one or more species of the bacterial consortia may facilitate or enhance the ability of other bacteria to fix nitrogen. The bacteria which fix nitrogen and the bacteria which enhance the ability of other bacteria to fix nitrogen may be the same or different. In some examples, a bacterial strain may be able to fix nitrogen when in combination with a different bacterial strain, or in a certain bacterial consortia, but may be unable to fix nitrogen in a monoculture. Examples of bacterial genuses which may be found in a nitrogen fixing bacterial consortia include, but are not limited to, *Herbaspirillum, Azospirillum, Enterobacter*, and *Bacillus*.

Bacteria that can be produced by the methods disclosed herein include *Azotobacter* sp., *Bradyrhizobium* sp., *Klebsiella* sp., and *Sinorhizobium* sp. In some cases, the bacteria may be selected from the group consisting of: *Azotobacter vinelandii, Bradyrhizobium japonicum, Klebsiella pneumoniae*, and *Sinorhizobium meliloti*. In some cases, the bacteria may be of the genus *Enterobacter* or *Rahnella*. In some cases, the bacteria may be of the genus *Frankia*, or *Clostridium*. Examples of bacteria of the genus *Clostridium* include, but are not limited to, *Clostridium acetobutilicum, Clostridium pasteurianum, Clostridium beijerinckii, Clostridium perfringens*, and *Clostridium tetani*. In some cases, the bacteria may be of the genus *Paenibacillus*, for example *Paenibacillus azotofixans, Paenibacillus borealis, Paenibacillus durus, Paenibacillus macerans, Paenibacillus polymyxa, Paenibacillus alvei, Paenibacillus amylolyticus, Paenibacillus campinasensis, Paenibacillus chibensis, Paenibacillus glucanolyticus, Paenibacillus illinoisensis, Paenibacillus larvae* subsp. Larvae, *Paenibacillus larvae* subsp. *Pulvifaciens, Paenibacillus lautus, Paenibacillus macerans, Paenibacillus macquariensis, Paenibacillus macquariensis, Paenibacillus pabuli, Paenibacillus peoriae*, or *Paenibacillus polymyxa.*

In some examples, bacteria isolated according to methods of the disclosure can be a member of one or more of the following taxa: *Achromobacter, Acidithiobacillus, Acidovorax, Acidovoraz, Acinetobacter, Actinoplanes, Adlercreutzia, Aerococcus, Aeromonas, Afipia, Agromyces, Ancylobacter, Arthrobacter, Atopostipes, Azospirillum, Bacillus, Bdellovibrio, Beijerinckia, Bosea, Bradyrhizobium, Brevibacillus, Brevundimonas, Burkholderia, Candidatus Haloredivivus, Caulobacter, Cellulomonas, Cellvibrio, Chryseobacterium, Citrobacter, Clostridium, Coraliomargarita, Corynebacterium, Cupriavidus, Curtobacterium, Curvibacter, Deinococcus, Delftia, Desemzia, Devosia, Dokdonella, Dyella, Enhydrobacter, Enterobacter, Enterococcus, Erwinia, Escherichia, Escherichia/Shigella, Exiguobacterium, Ferroglobus, Filimonas, Finegoldia, Flavisolibacter, Flavobacterium, Frigoribacterium, Gluconacetobacter, Hafnia, Halobaculum, Halomonas, Halosimplex, Herbaspirillum, Hymenobacter, Klebsiella, Kocuria, Kosakonia, Lactobacillus, Leclercia, Lentzea, Luteibacter, Luteimonas, Massilia,*

*Mesorhizobium, Methylobacterium, Microbacterium, Micrococcus, Microvirga, Mycobacterium, Neisseria, Nocardia, Oceanibaculum, Ochrobactrum, Okibacterium, Oligotropha, Oryzihumus, Oxalophagus, Paenibacillus, Panteoa, Pantoea, Pelomonas, Perlucidibaca, Plantibacter Polynucleobacter, Propionibacterium, Propioniciclava, Pseudoclavibacter, Pseudomonas, Pseudonocardia, Pseudoxanthomonas, Psychrobacter, Rahnella, Ralstonia, Rheinheimera, Rhizobium, Rhodococcus, Rhodopseudomonas, Roseateles, Ruminococcus, Sebaldella, Sediminibacillus, Sediminibacterium, Serratia, Shigella, Shinella, Sinorhizobium, Sinosporangium, Sphingobacterium, Sphingomonas, Sphingopyxis, Sphingosinicella, Staphylococcus,* 25 *Stenotrophomonas, Strenotrophomonas, Streptococcus, Streptomyces, Stygiolobus, Sulfurisphaera, Tatumella, Tepidimonas, Thermomonas, Thiobacillus, Variovorax,* WPS-2 genera incertae *sedis, Xanthomonas,* and *Zimmermannella.*

In some cases, a bacterial species selected from at least one of the following genera are utilized: *Enterobacter, Klebsiella, Kosakonia,* and *Rahnella.* In some cases, a combination of bacterial species from the following genera are utilized: *Enterobacter, Klebsiella, Kosakonia,* and *Rahnella.* In some cases, the species utilized can be one or more of: *Enterobacter sacchari, Klebsiella variicola, Kosakonia sacchari,* and *Rahnella* aquatilis.

In some cases, a Gram positive microbe may have a Molybdenum-Iron nitrogenase system comprising: nifH, nifD, nifK, nifB, nifE, nifN, nifX, hesA, nifV, nifW, nifU, nifS, nifI1, and nifI2. In some cases, a Gram positive microbe may have a vanadium nitrogenase system comprising: vnfDG, vnfK, vnfE, vnfN, vupC, vupB, vupA, vnfV, vnfR1, vnfH, vnfR2, vnfA (transcriptional regulator). In some cases, a Gram positive microbe may have an iron-only nitrogenase system comprising: anfK, anfG, anfD, anfH, anfA (transcriptional regulator). In some cases a Gram positive microbe may have a nitrogenase system comprising glnB, and glnK (nitrogen signaling proteins). Some examples of enzymes involved in nitrogen metabolism in Gram positive microbes include glnA (glutamine synthetase), gdh (glutamate dehydrogenase), bdh (3-hydroxybutyrate dehydrogenase), glutaminase, gltAB/gltB/gltS (glutamate synthase), asnA/asnB (aspartate-ammonia ligase/asparagine synthetase), and ansA/ansZ (asparaginase). Some examples of proteins involved in nitrogen transport in Gram positive microbes include amtB (ammonium transporter), glnK (regulator of ammonium transport), glnPHQ/glnQHMP (ATP-dependent glutamine/glutamate transporters), glnT/alsT/yrbD/yflA (glutamine-like proton symport transporters), and gltP/gltT/yhcl/nqt (glutamate-like proton symport transporters).

Examples of Gram positive microbes which may be of particular interest include *Paenibacillus polymixa, Paenibacillus riograndensis, Paenibacillus* sp., *Frankia* sp., *Heliobacterium* sp., *Heliobacterium chlorum, Heliobacillus* sp., *Heliophilum* sp., *Heliorestis* sp., *Clostridium acetobutylicum, Clostridium* sp., *Mycobacterium flaum, Mycobacterium* sp., *Arthrobacter* sp., *Agromyces* sp., *Corynebacterium autitrophicum, Corynebacterium* sp., *Micromonspora* sp., *Propionibacteria* sp., *Streptomyces* sp., and *Microbacterium* sp.

Some examples of genetic alterations which may be made in Gram positive microbes include: deleting glnR to remove negative regulation of BNF in the presence of environmental nitrogen, inserting different promoters directly upstream of the nif cluster to eliminate regulation by GlnR in response to environmental nitrogen, mutating glnA to reduce the rate of ammonium assimilation by the GS-GOGAT pathway, deleting amtB to reduce uptake of ammonium from the media, mutating glnA so it is constitutively in the feedback-inhibited (FBI-GS) state, to reduce ammonium assimilation by the GS-GOGAT pathway.

In some cases, glnR is the main regulator of N metabolism and fixation in *Paenibacillus* species. In some cases, the genome of a *Paenibacillus* species may not contain a gene to produce glnR. In some cases, the genome of a *Paenibacillus* species may not contain a gene to produce glnE or glnD. In some cases, the genome of a *Paenibacillus* species may contain a gene to produce glnB or glnK. For example, *Paenibacillus* sp. WLY78 doesn't contain a gene for glnB, or its homologs found in the archaeon Methanococcus maripaludis, nifI1 and nifI2. In some cases, the genomes of *Paenibacillus* species may be variable. For example, *Paenibacillus polymixa* E681 lacks glnK and gdh, has several nitrogen compound transporters, but only amtB appears to be controlled by GlnR. In another example, *Paenibacillus* sp. JDR2 has glnK, gdh and most other central nitrogen metabolism genes, has many fewer nitrogen compound transporters, but does have glnPHQ controlled by GlnR. *Paenibacillus riograndensis* SBR5 contains a standard glnRA operon, an fdx gene, a main nif operon, a secondary nif operon, and an anf operon (encoding iron-only nitrogenase). Putative glnR/tnrA sites were found upstream of each of these operons. GlnR may regulate all of the above operons, except the anf operon. GlnR may bind to each of these regulatory sequences as a dimer.

*Paenibacillus* N-fixing strains may fall into two subgroups: Subgroup I, which contains only a minimal nif gene cluster and subgroup II, which contains a minimal cluster, plus an uncharacterized gene between nifX and hesA, and often other clusters duplicating some of the nif genes, such as nifH, nifHDK, nifBEN, or clusters encoding vanadium nitrogenase (vnf) or iron-only nitrogenase (anf) genes.

In some cases, the genome of a *Paenibacillus* species may not contain a gene to produce glnB or glnK. In some cases, the genome of a *Paenibacillus* species may contain a minimal nif cluster with 9 genes transcribed from a sigma-70 promoter. In some cases, a *Paenibacillus* nif cluster may be negatively regulated by nitrogen or oxygen. In some cases, the genome of a *Paenibacillus* species may not contain a gene to produce sigma-54. For example, *Paenibacillus* sp. WLY78 does not contain a gene for sigma-54. In some cases, a nif cluster may be regulated by glnR, and/or TnrA. In some cases, activity of a nif cluster may be altered by altering activity of glnR, and/or TnrA.

In Bacilli, glutamine synthetase (GS) is feedback-inhibited by high concentrations of intracellular glutamine, causing a shift in confirmation (referred to as FBI-GS). Nif clusters contain distinct binding sites for the regulators GlnR and TnrA in several Bacilli species. GlnR binds and represses gene expression in the presence of excess intracellular glutamine and AMP. A role of GlnR may be to prevent the influx and intracellular production of glutamine and ammonium under conditions of high nitrogen availability. TnrA may bind and/or activate (or repress) gene expression in the presence of limiting intracellular glutamine, and/or in the presence of FBI-GS. In some cases, the activity of a Bacilli nif cluster may be altered by altering the activity of GlnR.

Feedback-inhibited glutamine synthetase (FBI-GS) may bind GlnR and stabilize binding of GlnR to recognition sequences. Several bacterial species have a GlnR/TnrA binding site upstream of the nif cluster. Altering the binding of FBI-GS and GlnR may alter the activity of the nif pathway.

Sources of Microbes

The bacteria (or any microbe according to the disclosure) may be obtained from any general terrestrial environment, including its soils, plants, fungi, animals (including invertebrates) and other biota, including the sediments, water and biota of lakes and rivers; from the marine environment, its biota and sediments (for example, sea water, marine muds, marine plants, marine invertebrates (for example, sponges), marine vertebrates (for example, fish)); the terrestrial and marine geosphere (regolith and rock, for example, crushed subterranean rocks, sand and clays); the cryosphere and its meltwater; the atmosphere (for example, filtered aerial dusts, cloud and rain droplets); urban, industrial and other man-made environments (for example, accumulated organic and mineral matter on concrete, roadside gutters, roof surfaces, and road surfaces).

The plants from which the bacteria (or any microbe according to the disclosure) are obtained may be a plant having one or more desirable traits, for example a plant that naturally grows in a particular environment or under certain conditions of interest. By way of example, a certain plant may naturally grow in sandy soil or sand of high salinity, or under extreme temperatures, or with little water, or it may be resistant to certain pests or disease present in the environment, and it may be desirable for a commercial crop to be grown in such conditions, particularly if they are, for example, the only conditions available in a particular geographic location. By way of further example, the bacteria may be collected from commercial crops grown in such environments, or more specifically from individual crop plants best displaying a trait of interest amongst a crop grown in any specific environment: for example the fastest-growing plants amongst a crop grown in saline-limiting soils, or the least damaged plants in crops exposed to severe insect damage or disease epidemic, or plants having desired quantities of certain metabolites and other compounds, including fiber content, oil content, and the like, or plants displaying desirable colors, taste or smell. The bacteria may be collected from a plant of interest or any material occurring in the environment of interest, including fungi and other animal and plant biota, soil, water, sediments, and other elements of the environment as referred to previously.

The bacteria (or any microbe according to the disclosure) may be isolated from plant tissue. This isolation can occur from any appropriate tissue in the plant, including for example root, stem and leaves, and plant reproductive tissues. By way of example, conventional methods for isolation from plants typically include the sterile excision of the plant material of interest (e.g. root or stem lengths, leaves), surface sterilization with an appropriate solution (e.g. 2% sodium hypochlorite), after which the plant material is placed on nutrient medium for microbial growth. Alternatively, the surface-sterilized plant material can be crushed in a sterile liquid (usually water) and the liquid suspension, including small pieces of the crushed plant material spread over the surface of a suitable solid agar medium, or media, which may or may not be selective (e.g. contain only phytic acid as a source of phosphorus). This approach is especially useful for bacteria which form isolated colonies and can be picked off individually to separate plates of nutrient medium, and further purified to a single species by well-known methods. Alternatively, the plant root or foliage samples may not be surface sterilized but only washed gently thus including surface-dwelling epiphytic microorganisms in the isolation process, or the epiphytic microbes can be isolated separately, by imprinting and lifting off pieces of plant roots, stem or leaves onto the surface of an agar medium and then isolating individual colonies as above. This approach is especially useful for bacteria, for example. Alternatively, the roots may be processed without washing off small quantities of soil attached to the roots, thus including microbes that colonize the plant rhizosphere. Otherwise, soil adhering to the roots can be removed, diluted and spread out onto agar of suitable selective and non-selective media to isolate individual colonies of rhizospheric bacteria.

Budapest Treaty on the International Recognition of the Deposit of Microorganisms for the Purpose of Patent Procedures The microbial deposits of the present disclosure were made under the provisions of the Budapest Treaty on the International Recognition of the Deposit of Microorganisms for the Purpose of Patent Procedure (Budapest Treaty).

Applicants state that pursuant to 37 C.F.R. § 1.808 (a) (2) "all restrictions imposed by the depositor on the availability to the public of the deposited material will be irrevocably removed upon the granting of the patent." This statement is subject to paragraph (b) of this section (i.e. 37 C.F.R. § 1.808 (b)).

The *Enterobacter sacchari* has now been reclassified as *Kosakonia sacchari*, the name for the organism may be used interchangeably throughout the manuscript.

Figure 6:
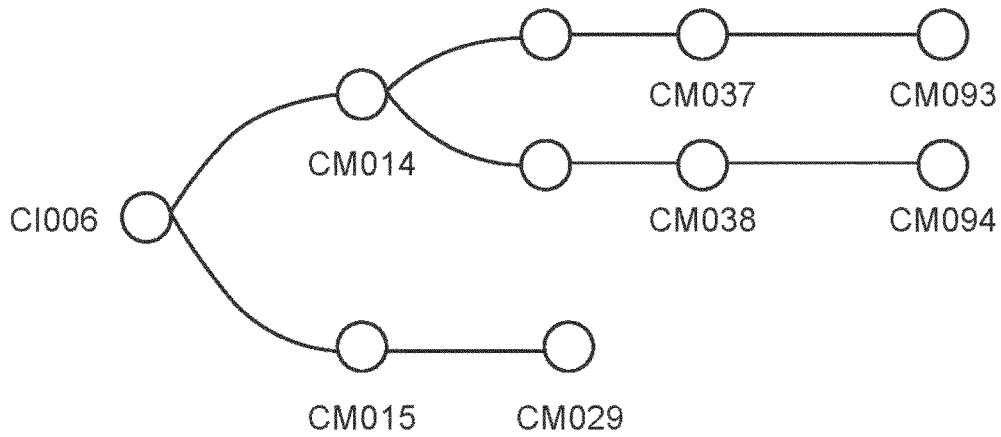
FIG. 6 depicts the lineage of modified strains that were derived from strain CI006.
Figure 7:
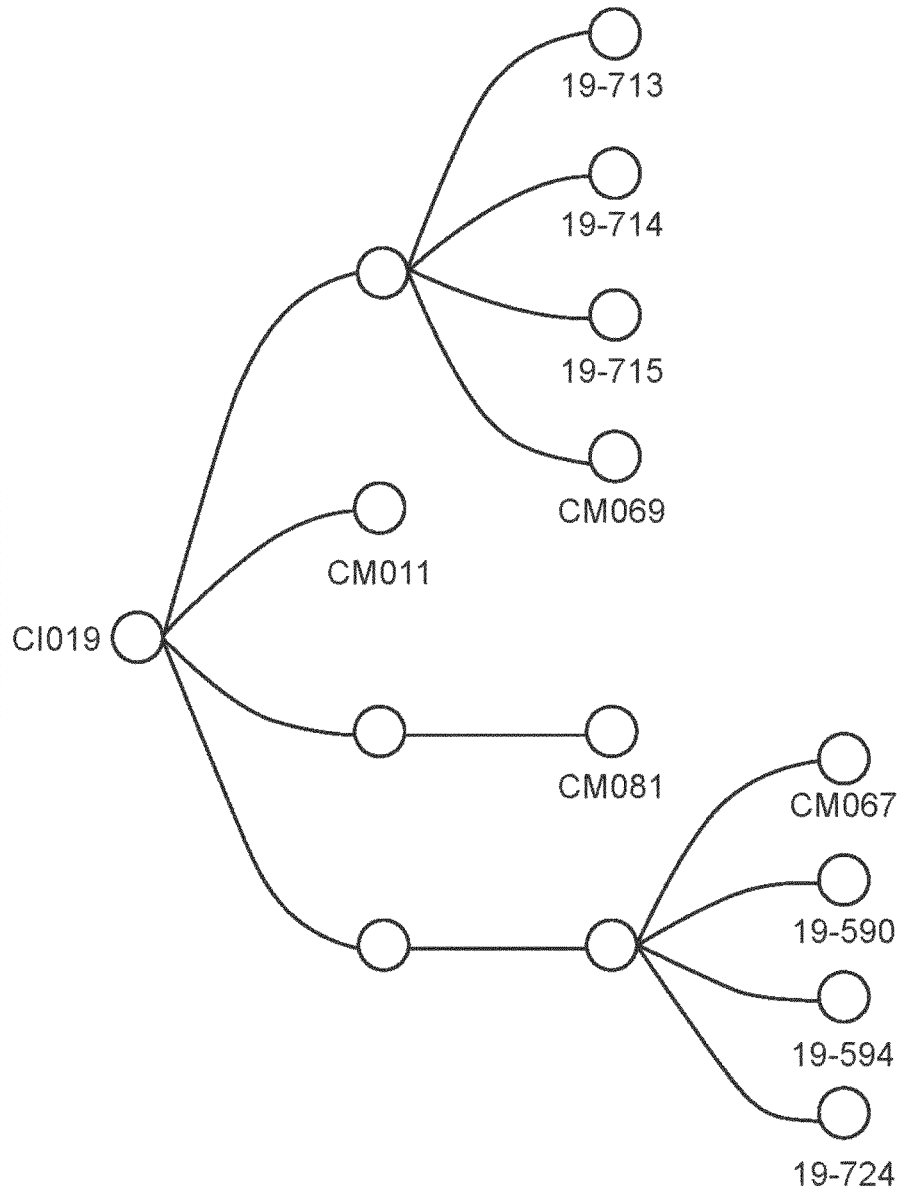
FIG. 7 depicts the lineage of modified strains that were derived from strain CI019.

Many microbes of the present disclosure are derived from two wild-type strains, as depicted in FIG. 6 and FIG. 7. Strain CI006 is a bacterial species previously classified in the genus *Enterobacter* (see aforementioned reclassification into *Kosakonia*), and FIG. 6 identifies the lineage of the mutants that have been derived from CI006. Strain CI019 is a bacterial species classified in the genus *Rahnella*, and FIG. 7 identifies the lineage of the mutants that have been derived from CI019. With regard to FIG. 6 and FIG. 7, it is noted that strains comprising CM in the name are mutants of the strains depicted immediately to the left of said CM strain. The deposit information for the CI006 *Kosakonia* wild type (WT) and CI019 *Rahnella* WT are found in the below Table 1.

Some microorganisms described in this application were deposited on Jan. 6, 2017 or Aug. 11, 2017 with the Bigelow National Center for Marine Algae and Microbiota (NCMA), located at 60 Bigelow Drive, East Boothbay, Maine 04544, USA. As aforementioned, all deposits were made under the terms of the Budapest Treaty on the International Recognition of the Deposit of Microorganisms for the Purposes of Patent Procedure. The Bigelow National Center for Marine Algae and Microbiota accession numbers and dates of deposit for the aforementioned Budapest Treaty deposits are provided in Table 1.

Biologically pure cultures of *Kosakonia sacchari* (WT), *Rahnella aquatilis* (WT), and a variant/remodeled *Kosakonia sacchari* strain were deposited on Jan. 6, 2017 with the Bigelow National Center for Marine Algae and Microbiota (NCMA), located at 60 Bigelow Drive, East Boothbay, Maine 04544, USA, and assigned NCMA Patent Deposit Designation numbers 201701001, 201701003, and 201701002, respectively. The applicable deposit information is found below in Table 1.

Biologically pure cultures of variant/remodeled *Kosakonia sacchari* strains were deposited on Aug. 11, 2017 with the Bigelow National Center for Marine Algae and Microbiota (NCMA), located at 60 Bigelow Drive, East Boothbay, Maine 04544, USA, and assigned NCMA Patent Deposit Designation numbers 201708004, 201708003, and 201708002, respectively. The applicable deposit information is found below in Table 1.

A biologically pure culture of *Klebsiella variicola* (WT) was deposited on Aug. 11, 2017 with the Bigelow National Center for Marine Algae and Microbiota (NCMA), located at 60 Bigelow Drive, East Boothbay, Maine 04544, USA, and assigned NCMA Patent Deposit Designation number 201708001. Biologically pure cultures of two *Klebsiella variicola* variants/remodeled strains were deposited on Dec. 20, 2017 with the Bigelow National Center for Marine Algae and Microbiota (NCMA), located at 60 Bigelow Drive, East Boothbay, Maine 04544, USA, and assigned NCMA Patent Deposit Designation numbers 201712001 and 201712002, respectively. The applicable deposit information is found below in Table 1.

listed in Table 1, said combinations sometimes forming a microbial consortia. The microbes from Table 1, either individually or in any combination, can be combined with any plant, active molecule (synthetic, organic, etc.), adjuvant, carrier, supplement, or biological, mentioned in the disclosure.

In some aspects, the disclosure provides microbial compositions comprising species as grouped in Tables 2-8. In some aspects, these compositions comprising various microbial species are termed a microbial consortia or consortium.

With respect to Tables 2-8, the letters A through I represent a non-limiting selection of microorganisms of the present disclosure, defined as:

TABLE 1

| Microorganisms Deposited under the Budapest Treaty | | | | |
| --- | --- | --- | --- | --- |
| Depository | Pivot Strain Designation (some strains have multiple designations) | Taxonomy | Accession Number | Date of Deposit |
| NCMA | CI006, PBC6.1, 6 | *Kosakonia sacchari* (WT) | 201701001 | Jan. 6, 2017 |
| NCMA | CI019, 19 | *Rahnella aquatilis* (WT) | 201701003 | Jan. 6, 2017 |
| NCMA | CM029, 6-412 | *Kosakonia sacchari* | 201701002 | Jan. 6, 2017 |
| NCMA | 6-403 CM037 | *Kosakonia sacchari* | 201708004 | Aug. 11, 2017 |
| NCMA | 6-404, CM38, PBC6.38 | *Kosakonia sacchari* | 201708003 | Aug. 11, 2017 |
| NCMA | CM094, 6-881, PBC6.94 | *Kosakonia sacchari* | 201708002 | Aug. 11, 2017 |
| NCMA | CI137, 137, PB137 | *Klebsiella variicola* (WT) | 201708001 | Aug. 11, 2017 |
| NCMA | 137-1034 | *Klebsiella variicola* | 201712001 | Dec. 20, 2017 |
| NCMA | 137-1036 | *Klebsiella variicola* | 201712002 | Dec. 20, 2017 |

Isolated and Biologically Pure Microorganisms

The present disclosure, in certain embodiments, provides isolated and biologically pure microorganisms that have applications, inter alia, in agriculture. The disclosed microorganisms can be utilized in their isolated and biologically pure states, as well as being formulated into compositions (see below section for exemplary composition descriptions). Furthermore, the disclosure provides microbial compositions containing at least two members of the disclosed isolated and biologically pure microorganisms, as well as methods of utilizing said microbial compositions. Furthermore, the disclosure provides for methods of modulating nitrogen fixation in plants via the utilization of the disclosed isolated and biologically pure microbes.

In some aspects, the isolated and biologically pure microorganisms of the disclosure are those from Table 1. In other aspects, the isolated and biologically pure microorganisms of the disclosure are derived from a microorganism of Table 1. For example, a strain, child, mutant, or derivative, of a microorganism from Table 1 are provided herein. The disclosure contemplates all possible combinations of microbes A=Microbe with accession number 201701001 identified in Table 1;

B=Microbe with accession number 201701003 identified in Table 1;

C=Microbe with accession number 201701002 identified in Table 1;

D=Microbe with accession number 201708004 identified in Table 1;

E=Microbe with accession number 201708003 identified in Table 1;

F=Microbe with accession number 201708002 identified in Table 1;

G=Microbe with accession number 201708001 identified in Table 1;

H=Microbe with accession number 201712001 identified in Table 1; and

I=Microbe with accession number 201712002 identified in Table 1.

TABLE 2

Eight and Nine Strain Compositions

| | | | | | |
|---|---|---|---|---|---|
| A, B, C, D, E, F, G, H | A, B, C, D, E, F, G, I | A, B, C, D, E, F, H, I | A, B, C, D, E, G, H, I | A, B, C, D, F, G, H, I | A, B, C, E, F, G, H, I |
| A, B, D, E, F, G, H, I | A, C, D, E, F, G, H, I | B, C, D, E, F, G, H, I | A, B, C, D, E, F, G, H, I | | |

TABLE 3

Seven Strain Compositions

| | | | | | |
|---|---|---|---|---|---|
| A, B, C, D, E, F, G | A, B, C, D, E, F, H | A, B, C, D, E, F, I | A, B, C, D, E, G, H | A, B, C, D, E, G, I | A, B, C, D, E, H, I |
| A, B, C, D, F, G, H | A, B, C, D, F, G, I | A, B, C, D, F, H, I | A, B, C, D, G, H, I | A, B, C, E, F, G, H | A, B, C, E, F, G, I |
| A, B, C, E, F, H, I | A, B, C, E, G, H, I | A, B, C, F, G, H, I | A, B, D, E, F, G, H | A, B, D, E, F, G, I | A, B, D, E, F, H, I |
| A, B, D, E, G, H, I | A, B, D, F, G, H, I | A, B, E, F, G, H, I | A, C, D, E, F, G, H | A, C, D, E, F, G, I | A, C, D, E, F, H, I |
| A, C, D, E, G, H, I | A, C, D, F, G, H, I | A, C, E, F, G, H, I | A, D, E, F, G, H, I | B, C, D, E, F, G, H | B, C, D, E, F, G, I |
| B, C, D, E, F, H, I | B, C, D, E, G, H, I | B, C, D, F, G, H, I | B, C, E, F, G, H, I | B, D, E, F, G, H, I | C, D, E, F, G, H, I |

TABLE 4

Six Strain Compositions

| | | | | | | |
|---|---|---|---|---|---|---|
| A, B, C, D, E, F | A, B, C, D, E, G | A, B, C, D, E, H | A, B, C, D, E, I | A, B, C, D, F, G | A, B, C, D, F, H | A, B, C, D, F, I |
| A, B, C, D, G, H | A, B, C, D, G, I | A, B, C, D, H, I | A, B, C, E, F, G | A, B, C, E, F, H | A, B, C, E, F, I | A, B, C, E, G, H |
| A, B, C, E, G, I | A, B, C, E, H, I | A, B, C, F, G, H | A, B, C, F, G, I | A, B, C, F, H, I | A, B, C, G, H, I | A, B, D, E, F, G |
| A, B, D, E, F, H | A, B, D, E, F, I | A, B, D, E, G, H | A, B, D, E, G, I | A, B, D, E, H, I | A, B, D, F, G, H | A, B, D, F, G, I |
| D, E, F, G, H, I | C, E, F, G, H, I | A, B, D, F, H, I | A, B, D, G, H, I | A, B, E, F, G, H | A, B, E, F, G, I | A, B, E, F, H, I |
| A, B, E, G, H, I | A, B, F, G, H, I | A, C, D, E, F, G | A, C, D, E, F, H | A, C, D, E, F, I | A, C, D, E, G, H | A, C, D, E, G, I |
| A, C, D, E, H, I | A, C, D, F, G, H | A, C, D, F, G, I | A, C, D, F, H, I | A, C, D, G, H, I | A, C, E, F, G, H | A, C, E, F, G, I |
| A, C, E, F, H, I | A, C, E, G, H, I | A, C, F, G, H, I | A, D, E, F, G, H | A, D, E, F, G, I | A, D, E, F, H, I | A, D, E, G, H, I |
| A, D, F, G, H, I | A, E, F, G, H, I | B, C, D, E, F, G | B, C, D, E, F, H | B, C, D, E, F, I | B, C, D, E, G, H | B, C, D, E, G, I |
| B, C, D, E, H, I | B, C, D, F, G, H | B, C, D, F, G, I | B, C, D, F, H, I | B, C, D, G, H, I | B, C, E, F, G, H | B, C, E, F, G, I |
| B, C, E, F, H, I | B, C, E, G, H, I | B, C, F, G, H, I | B, D, E, F, G, H | B, D, E, F, G, I | B, D, E, F, H, I | B, D, E, G, H, I |
| B, D, F, G, H, I | B, E, F, G, H, I | C, D, E, F, G, H | C, D, E, F, G, I | C, D, E, F, H, I | C, D, E, G, H, I | C, D, F, G, H, I |

TABLE 5

Five Strain Compositions

| | | | | | | | |
|---|---|---|---|---|---|---|---|
| A, B, C, D, E | A, B, C, D, F | A, B, C, D, G | A, B, C, D, H | A, B, C, D, I | A, B, C, E, F | A, B, C, E, G | A, B, C, E, H |
| A, B, C, F, G | A, B, C, F, H | A, B, C, F, I | A, B, C, G, H | A, B, C, G, I | A, B, C, H, I | A, B, D, E, F | A, B, D, E, G |
| A, B, D, E, I | A, B, D, F, G | A, B, D, F, H | A, B, D, F, I | A, B, D, G, H | A, B, D, G, I | A, B, D, H, I | A, B, E, F, G |
| A, B, E, F, I | A, B, E, G, H | A, B, E, G, I | A, B, E, H, I | A, B, F, G, H | A, B, F, G, I | A, B, F, H, I | A, B, G, H, I |
| A, C, D, E, G | A, C, D, E, H | A, C, D, E, I | A, C, D, F, G | A, C, D, F, H | A, C, D, F, I | A, C, D, G, H | A, C, D, G, I |
| A, C, E, F, G | A, C, E, F, H | A, C, E, F, I | A, C, E, G, H | A, C, E, G, I | A, C, E, H, I | A, C, F, G, H | A, C, F, G, I |
| A, C, G, H, I | A, D, E, F, G | A, D, E, F, H | A, D, E, F, I | A, D, E, G, H | A, D, E, G, I | A, D, E, H, I | A, D, F, G, H |
| A, D, F, H, I | A, D, G, H, I | A, E, F, G, H | A, E, F, G, I | A, E, F, H, I | A, E, G, H, I | A, F, G, H, I | B, C, D, E, F |
| B, C, D, E, H | B, C, D, E, I | B, C, D, F, G | B, C, D, F, H | B, C, D, F, I | B, C, D, G, H | B, C, D, G, I | B, C, D, H, I |
| B, C, E, F, H | B, C, E, F, I | B, C, E, G, H | B, C, E, G, I | B, C, E, H, I | B, C, F, G, H | B, C, F, G, I | B, C, F, H, I |
| B, D, E, F, G | B, D, E, F, H | B, D, E, F, I | B, D, E, G, H | B, D, E, G, I | B, D, E, H, I | B, D, F, G, H | B, D, F, G, I |
| B, D, G, H, I | B, E, F, G, H | B, E, F, G, I | B, E, F, H, I | B, E, G, H, I | B, F, G, H, I | C, D, E, F, G | C, D, E, F, H |
| C, D, E, G, H | C, D, E, G, I | C, D, E, H, I | C, D, F, G, H | C, D, F, G, I | C, D, F, H, I | C, D, G, H, I | C, E, F, G, H |
| C, E, F, H, I | C, E, G, H, I | C, F, G, H, I | D, E, F, G, H | D, E, F, G, I | D, E, F, H, I | D, E, G, H, I | D, F, G, H, I |
| A, B, C, E, I | A, B, D, E, H | A, B, E, F, H | A, C, D, E, F | A, C, D, H, I | A, C, F, H, I | A, D, F, G, I | B, C, D, E, G |
| B, C, E, F, G | B, C, G, H, I | B, D, F, H, I | C, D, E, F, I | C, E, F, G, I | E, F, G, H, I | | |

TABLE 6

Four Strain Compositions

| | | | | | | | | |
|---|---|---|---|---|---|---|---|---|
| A, B, C, D | A, B, C, E | A, B, C, F | A, B, C, G | A, B, C, H | A, B, C, I | A, B, D, E | A, B, D, F | D, G, H, I |
| A, B, D, G | A, B, D, H | A, B, D, I | A, B, E, F | A, B, E, G | A, B, E, H | A, B, E, I | A, B, F, G | E, F, G, H |
| A, B, F, H | A, D, F, H | A, D, F, I | A, D, G, H | A, D, G, I | A, D, H, I | A, E, F, G | A, E, F, H | E, F, G, I |
| A, B, F, I | A, B, G, H | A, B, G, I | A, B, H, I | A, C, D, E | A, C, D, F | A, C, D, G | A, C, D, H | E, F, H, I |
| A, C, D, I | A, C, E, F | A, C, E, G | A, C, E, H | A, C, E, I | A, C, F, G | A, C, F, H | A, C, F, I | E, G, H, I |

TABLE 6-continued

| | | | Four Strain Compositions | | | | | | |
|---|---|---|---|---|---|---|---|---|---|
| A, C, G, H | A, C, G, I | A, C, H, I | A, D, E, F | A, D, E, G | A, D, E, H | A, D, E, I | A, D, F, G | F, G, H, I | |
| A, E, F, I | A, E, G, H | A, E, G, I | A, E, H, I | A, F, G, H | A, F, G, I | A, F, H, I | A, G, H, I | D, E, F, H | |
| B, C, D, E | B, C, D, F | B, C, D, G | B, C, D, H | B, C, D, I | B, C, E, F | B, C, E, G | B, C, E, H | D, E, F, I | |
| B, C, E, I | B, C, F, G | B, C, F, H | B, C, F, I | B, C, G, H | B, C, G, I | B, C, H, I | B, D, E, F | D, E, G, H | |
| B, D, E, G | B, D, E, H | B, D, E, I | B, D, F, G | B, D, F, H | B, D, F, I | B, D, G, H | B, D, G, I | D, E, G, I | |
| B, D, H, I | B, E, F, G | B, E, F, H | B, E, F, I | B, E, G, I | B, E, H, I | B, E, H, I | B, F, G, H | D, E, H, I | |
| B, F, G, I | B, F, H, I | B, G, H, I | C, D, E, F | C, D, E, G | C, D, E, H | C, D, E, I | C, D, F, G | D, F, G, H | |
| C, D, F, H | C, D, F, I | C, D, G, H | C, D, G, I | C, D, H, I | C, E, F, G | C, E, F, H | C, E, F, I | D, F, G, I | |
| C, E, G, H | C, E, G, I | C, E, H, I | C, F, G, H | C, F, G, I | C, F, H, I | C, G, H, I | D, E, F, G | D, F, H, I | |

TABLE 7

| | | | | Three Strain Compositions | | | | | |
|---|---|---|---|---|---|---|---|---|---|
| A, B, C | A, B, D | A, B, E | A, B, F | A, B, G | A, B, H | A, B, I | A, C, D | A, C, E | G, H, I | E, F, H |
| A, C, F | A, C, G | A, C, H | A, C, I | A, D, E | A, D, F | A, D, G | A, D, H | A, D, I | F, H, I | E, F, G |
| A, E, F | A, E, G | A, E, H | A, E, I | A, F, G | A, F, H | A, F, I | A, G, H | A, G, I | F, G, I | D, H, I |
| A, H, I | B, C, D | B, C, E | B, C, F | B, C, G | B, C, H | B, C, I | B, D, E | B, D, F | F, G, H | D, G, I |
| B, D, G | B, D, H | B, D, I | B, E, F | B, E, G | B, E, H | B, E, I | B, F, G | B, F, H | E, H, I | E, F, I |
| B, F, I | B, G, H | B, G, I | B, H, I | C, D, E | C, D, F | C, D, G | C, D, H | C, D, I | E, G, I | D, G, H |
| C, E, F | C, E, G | C, E, H | C, E, I | C, F, G | C, F, H | C, F, I | C, G, H | C, G, I | E, G, H | D, F, I |
| C, H, I | D, E, F | D, E, G | D, E, H | D, E, I | D, F, G | D, F, H | | | | |

TABLE 8

| | | | | Two Strain Compositions | | | | | | | | | | | |
|---|---|---|---|---|---|---|---|---|---|---|---|---|---|---|---|
| A, B | A, C | A, D | A, E | A, F | A, G | A, H | A, I | B, C | B, D | B, E | B, F | B, G | B, H | B, I | C, D |
| C, E | C, F | C, G | C, H | C, I | D, E | D, F | D, G | D, H | D, I | E, F | E, G | E, H | E, I | F, G | F, H |
| F, I | G, H | G, I | H, I | | | | | | | | | | | | |

In some embodiments, microbial compositions may be selected from any member group from Tables 2-8.

Agricultural Compositions

Compositions comprising bacteria or bacterial populations produced according to methods described herein and/or having characteristics as described herein can be in the form of a liquid, a foam, or a dry product. Compositions comprising bacteria or bacterial populations produced according to methods described herein and/or having characteristics as described herein may also be used to improve plant traits. In some examples, a composition comprising bacterial populations may be in the form of a dry powder, a slurry of powder and water, or a flowable seed treatment. The compositions comprising bacterial populations may be coated on a surface of a seed, and may be in liquid form.

The composition can be fabricated in bioreactors such as continuous stirred tank reactors, batch reactors, and on the farm. In some examples, compositions can be stored in a container, such as a jug or in mini bulk. In some examples, compositions may be stored within an object selected from the group consisting of a bottle, jar, ampule, package, vessel, bag, box, bin, envelope, carton, container, silo, shipping container, truck bed, and/or case.

Compositions may also be used to improve plant traits. In some examples, one or more compositions may be coated onto a seed. In some examples, one or more compositions may be coated onto a seedling. In some examples, one or more compositions may be coated onto a surface of a seed. In some examples, one or more compositions may be coated as a layer above a surface of a seed. In some examples, a composition that is coated onto a seed may be in liquid form, in dry product form, in foam form, in a form of a slurry of powder and water, or in a flowable seed treatment. In some examples, one or more compositions may be applied to a seed and/or seedling by spraying, immersing, coating, encapsulating, and/or dusting the seed and/or seedling with the one or more compositions. In some examples, multiple bacteria or bacterial populations can be coated onto a seed and/or a seedling of the plant. In some examples, at least two, at least three, at least four, at least five, at least six, at least seven, at least eight, at least nine, at least ten, or more than ten bacteria of a bacterial combination can be selected from one of the following genera: Acidovorax, *Agrobacterium, Bacillus, Burkholderia, Chryseobacterium, Curtobacterium, Enterobacter, Escherichia, Methylobacterium, Paenibacillus, Pantoea, Pseudomonas, Ralstonia, Saccharibacillus, Sphingomonas,* and *Stenotrophomonas.*

In some examples, at least two, at least three, at least four, at least five, at least six, at least seven, at least eight, at least nine, at least ten, or more than ten bacteria and bacterial populations of an endophytic combination are selected from one of the following families: Bacillaceae, Burkholderiaceae, Comamonadaceae, Enterobacteriaceae, Flavobacteriaceae, Methylobacteriaceae, Microbacteriaceae, Paenibacillileae, Pseudomonnaceae, Rhizobiaceae, Sphingomonadaceae, Xanthomonadaceae, Cladosporiaceae, Gnomoniaceae, Incertae sedis, Lasiosphaeriaceae, Netriaceae, and Pleosporaceae.

In some examples, at least two, at least three, at least four, at least five, at least six, at least seven, at least eight, at least night, at least ten, or more than ten bacteria and bacterial populations of an endophytic combination are selected from one of the following families: Bacillaceae, Burkholderiaceae, Comamonadaceae, Enterobacteriaceae, Flavobacteriaceae, Methylobacteriaceae, Microbacteriaceae, Paenibacillileae, Pseudomonnaceae, Rhizobiaceae, Sphingomonadaceae, Xanthomonadaceae, Cladosporiaceae, Gnomoniaceae, Incertae sedis, Lasiosphaeriaceae, Netriaceae, Pleosporaceae.

Examples of compositions may include seed coatings for commercially important agricultural crops, for example, *sorghum*, canola, tomato, strawberry, barley, rice, maize, and wheat. Examples of compositions can also include seed coatings for corn, soybean, canola, *sorghum*, potato, rice, vegetables, cereals, and oilseeds. Seeds as provided herein can be genetically modified organisms (GMO), non-GMO, organic, or conventional. In some examples, compositions may be sprayed on the plant aerial parts, or applied to the roots by inserting into furrows in which the plant seeds are planted, watering to the soil, or dipping the roots in a suspension of the composition. In some examples, compositions may be dehydrated in a suitable manner that maintains cell viability and the ability to artificially inoculate and colonize host plants. The bacterial species may be present in compositions at a concentration of between $10^8$ to 1010 CFU/ml. In some examples, compositions may be supplemented with trace metal ions, such as molybdenum ions, iron ions, manganese ions, or combinations of these ions. The concentration of ions in examples of compositions as described herein may between about 0.1 mM and about 50 mM. Some examples of compositions may also be formulated with a carrier, such as beta-glucan, carboxylmethyl cellulose (CMC), bacterial extracellular polymeric substance (EPS), sugar, animal milk, or other suitable carriers. In some examples, peat or planting materials can be used as a carrier, or biopolymers in which a composition is entrapped in the biopolymer can be used as a carrier. The compositions comprising the bacterial populations described herein can improve plant traits, such as promoting plant growth, maintaining high chlorophyll content in leaves, increasing fruit or seed numbers, and increasing fruit or seed unit weight.

The compositions comprising the bacterial populations described herein may be coated onto the surface of a seed. As such, compositions comprising a seed coated with one or more bacteria described herein are also contemplated. The seed coating can be formed by mixing the bacterial population with a porous, chemically inert granular carrier. Alternatively, the compositions may be inserted directly into the furrows into which the seed is planted or sprayed onto the plant leaves or applied by dipping the roots into a suspension of the composition. An effective amount of the composition can be used to populate the sub-soil region adjacent to the roots of the plant with viable bacterial growth, or populate the leaves of the plant with viable bacterial growth. In general, an effective amount is an amount sufficient to result in plants with improved traits (e.g. a desired level of nitrogen fixation).

Bacterial compositions described herein can be formulated using an agriculturally acceptable carrier. The formulation useful for these embodiments may include at least one member selected from the group consisting of a tackifier, a microbial stabilizer, a fungicide, an antibacterial agent, a preservative, a stabilizer, a surfactant, an anti-complex agent, an herbicide, a nematicide, an insecticide, a plant growth regulator, a fertilizer, a rodenticide, a desiccant, a bactericide, a nutrient, and any combination thereof. In some examples, compositions may be shelf-stable. For example, any of the compositions described herein can include an agriculturally acceptable carrier (e.g., one or more of a fertilizer such as a non-naturally occurring fertilizer, an adhesion agent such as a non-naturally occurring adhesion agent, and a pesticide such as a non-naturally occurring pesticide). A non-naturally occurring adhesion agent can be, for example, a polymer, copolymer, or synthetic wax. For example, any of the coated seeds, seedlings, or plants described herein can contain such an agriculturally acceptable carrier in the seed coating. In any of the compositions or methods described herein, an agriculturally acceptable carrier can be or can include a non-naturally occurring compound (e.g., a non-naturally occurring fertilizer, a non-naturally occurring adhesion agent such as a polymer, copolymer, or synthetic wax, or a non-naturally occurring pesticide). Non-limiting examples of agriculturally acceptable carriers are described below. Additional examples of agriculturally acceptable carriers are known in the art.

In some cases, bacteria are mixed with an agriculturally acceptable carrier. The carrier can be a solid carrier or liquid carrier, and in various forms including microspheres, powders, emulsions and the like. The carrier may be any one or more of a number of carriers that confer a variety of properties, such as increased stability, wettability, or dispersability. Wetting agents such as natural or synthetic surfactants, which can be nonionic or ionic surfactants, or a combination thereof can be included in the composition. Water-in-oil emulsions can also be used to formulate a composition that includes the isolated bacteria (see, for example, U.S. Pat. No. 7,485,451). Suitable formulations that may be prepared include wettable powders, granules, gels, agar strips or pellets, thickeners, and the like, microencapsulated particles, and the like, liquids such as aqueous flowables, aqueous suspensions, water-in-oil emulsions, etc. The formulation may include grain or legume products, for example, ground grain or beans, broth or flour derived from grain or beans, starch, sugar, or oil.

In some embodiments, the agricultural carrier may be soil or a plant growth medium. Other agricultural carriers that may be used include water, fertilizers, plant-based oils, humectants, or combinations thereof. Alternatively, the agricultural carrier may be a solid, such as diatomaceous earth, loam, silica, alginate, clay, bentonite, vermiculite, seed cases, other plant and animal products, or combinations, including granules, pellets, or suspensions. Mixtures of any of the aforementioned ingredients are also contemplated as carriers, such as but not limited to, pesta (flour and kaolin clay), agar or flour-based pellets in loam, sand, or clay, etc. Formulations may include food sources for the bacteria, such as barley, rice, or other biological materials such as seed, plant parts, sugar cane bagasse, hulls or stalks from grain processing, ground plant material or wood from building site refuse, sawdust or small fibers from recycling of paper, fabric, or wood.

For example, a fertilizer can be used to help promote the growth or provide nutrients to a seed, seedling, or plant. Non-limiting examples of fertilizers include nitrogen, phosphorous, potassium, calcium, sulfur, magnesium, boron, chloride, manganese, iron, zinc, copper, molybdenum, and selenium (or a salt thereof). Additional examples of fertilizers include one or more amino acids, salts, carbohydrates, vitamins, glucose, NaCl, yeast extract, $NH_4H_2PO_4$, $(NH_4)_2 SO_4$, glycerol, valine, L-leucine, lactic acid, propionic acid, succinic acid, malic acid, citric acid, KH tartrate, xylose, lyxose, and lecithin. In one embodiment, the formulation can include a tackifier or adherent (referred to as an adhesive agent) to help bind other active agents to a substance (e.g., a surface of a seed). Such agents are useful for combining bacteria with carriers that can contain other compounds (e.g., control agents that are not biologic), to yield a coating composition. Such compositions help create coatings around the plant or seed to maintain contact between the microbe and other agents with the plant or plant part. In one embodiment, adhesives are selected from the group consisting of: alginate, gums, starches, lecithins, formononetin, polyvinyl alcohol, alkali formononetinate, hesperetin, polyvinyl acetate, cephalins, Gum Arabic, Xanthan Gum, Mineral Oil, Polyethylene Glycol (PEG), Polyvinyl pyrrolidone (PVP), Arabino-galactan, Methyl Cellulose, PEG 400, Chitosan, Polyacrylamide, Polyacrylate, Polyacrylonitrile, Glycerol, Triethylene glycol, Vinyl Acetate, Gellan Gum, Polystyrene, Polyvinyl, Carboxymethyl cellulose, Gum Ghatti, and polyoxyethylene-polyoxybutylene block copolymers.

In some embodiments, the adhesives can be, e.g. a wax such as carnauba wax, beeswax, Chinese wax, shellac wax, spermaceti wax, candelilla wax, castor wax, ouricury wax, and rice bran wax, a polysaccharide (e.g., starch, dextrins, maltodextrins, alginate, and chitosans), a fat, oil, a protein (e.g., gelatin and zeins), gum arables, and shellacs. Adhesive agents can be non-naturally occurring compounds, e.g., polymers, copolymers, and waxes. For example, non-limiting examples of polymers that can be used as an adhesive agent include: polyvinyl acetates, polyvinyl acetate copolymers, ethylene vinyl acetate (EVA) copolymers, polyvinyl alcohols, polyvinyl alcohol copolymers, celluloses (e.g., ethylcelluloses, methylcelluloses, hydroxymethylcelluloses, hydroxypropylcelluloses, and carboxymethylcelluloses), polyvinylpyrolidones, vinyl chloride, vinylidene chloride copolymers, calcium lignosulfonates, acrylic copolymers, polyvinylacrylates, polyethylene oxide, acylamide polymers and copolymers, polyhydroxyethyl acrylate, methylacrylamide monomers, and polychloroprene.

In some examples, one or more of the adhesion agents, anti-fungal agents, growth regulation agents, and pesticides (e.g., insecticide) are non-naturally occurring compounds (e.g., in any combination). Additional examples of agriculturally acceptable carriers include dispersants (e.g., polyvinylpyrrolidone/vinyl acetate PVPIVA S-630), surfactants, binders, and filler agents.

The formulation can also contain a surfactant. Non-limiting examples of surfactants include nitrogen-surfactant blends such as Prefer 28 (Cenex), Surf-N(US), Inhance (Brandt), P-28 (Wilfarm) and Patrol (Helena); esterified seed oils include Sun-It II (AmCy), MSO (UAP), Scoil (Agsco), Hasten (Wilfarm) and Mes-100 (Drexel); and organo-silicone surfactants include Silwet L77 (UAP), Silikin (Terra), Dyne-Amic (Helena), Kinetic (Helena), Sylgard 309 (Wilbur-Ellis) and Century (Precision). In one embodiment, the surfactant is present at a concentration of between 0.01% v/v to 10% v/v. In another embodiment, the surfactant is present at a concentration of between 0.1% v/v to 1% v/v.

In certain cases, the formulation includes a microbial stabilizer. Such an agent can include a desiccant, which can include any compound or mixture of compounds that can be classified as a desiccant regardless of whether the compound or compounds are used in such concentrations that they in fact have a desiccating effect on a liquid inoculant. Such desiccants are ideally compatible with the bacterial population used, and should promote the ability of the microbial population to survive application on the seeds and to survive desiccation. Examples of suitable desiccants include one or more of trehalose, sucrose, glycerol, and Methylene glycol. Other suitable desiccants include, but are not limited to, non-reducing sugars and sugar alcohols (e.g., mannitol or sorbitol). The amount of desiccant introduced into the formulation can range from about 5% to about 50% by weight/volume, for example, between about 10% to about 40%, between about 15% to about 35%, or between about 20% to about 30%. In some cases, it is advantageous for the formulation to contain agents such as a fungicide, an antibacterial agent, an herbicide, a nematicide, an insecticide, a plant growth regulator, a rodenticide, bactericide, or a nutrient. In some examples, agents may include protectants that provide protection against seed surface-borne pathogens. In some examples, protectants may provide some level of control of soil-borne pathogens. In some examples, protectants may be effective predominantly on a seed surface.

In some examples, a fungicide may include a compound or agent, whether chemical or biological, that can inhibit the growth of a fungus or kill a fungus. In some examples, a fungicide may include compounds that may be fungistatic or fungicidal. In some examples, fungicide can be a protectant, or agents that are effective predominantly on the seed surface, providing protection against seed surface-borne pathogens and providing some level of control of soil-borne pathogens. Non-limiting examples of protectant fungicides include captan, maneb, thiram, or fludioxonil.

In some examples, fungicide can be a systemic fungicide, which can be absorbed into the emerging seedling and inhibit or kill the fungus inside host plant tissues. Systemic fungicides used for seed treatment include, but are not limited to the following: azoxystrobin, carboxin, mefenoxam, metalaxyl, thiabendazole, trifloxystrobin, and various triazole fungicides, including difenoconazole, ipconazole, tebuconazole, and triticonazole. Mefenoxam and metalaxyl are primarily used to target the water mold fungi *Pythium* and *Phytophthora*. Some fungicides are preferred over others, depending on the plant species, either because of subtle differences in sensitivity of the pathogenic fungal species, or because of the differences in the fungicide distribution or sensitivity of the plants. In some examples, fungicide can be a biological control agent, such as a bacterium or fungus. Such organisms may be parasitic to the pathogenic fungi, or secrete toxins or other substances which can kill or otherwise prevent the growth of fungi. Any type of fungicide, particularly ones that are commonly used on plants, can be used as a control agent in a seed composition.

In some examples, the seed coating composition comprises a control agent that has antibacterial properties. In one embodiment, the control agent with antibacterial properties is selected from the compounds described herein elsewhere. In another embodiment, the compound is Streptomycin, oxytetracycline, oxolinic acid, or gentamicin. Other examples of antibacterial compounds which can be used as part of a seed coating composition include those based on dichlorophene and benzylalcohol hemi formal (Proxel® from ICI or Acticide® RS from Thor Chemie and Kathon® MK 25 from Rohm & Haas) and isothiazolinone derivatives such as alkylisothiazolinones and benzisothiazolinones (Acticide® MBS from Thor Chemie).

In some examples, growth regulator is selected from the group consisting of: Abscisic acid, amidochlor, ancymidol, 6-benzylaminopurine, brassinolide, butralin, chlormequat (chlormequat chloride), choline chloride, cyclanilide, daminozide, dikegulac, dimethipin, 2,6-dimethylpuridine, ethephon, flumetralin, flurprimidol, fluthiacet, forchlorfenuron, gibberellic acid, inabenfide, indole-3-acetic acid, maleic hydrazide, mefluidide, mepiquat (mepiquat chloride), naphthaleneacetic acid, N-6-benzyladenine, paclobutrazol, prohexadione phosphorotrithioate, 2,3,5-tri-iodobenzoic acid, trinexapac-ethyl and uniconazole. Additional non-limiting examples of growth regulators include brassinosteroids, cytokinins (e.g., kinetin and zeatin), auxins (e.g., indolylacetic acid and indolylacetyl aspartate), flavonoids and isoflavanoids (e.g., formononetin and diosmetin), phytoaixins (e.g., glyceolline), and phytoalexin-inducing oligosaccharides (e.g., pectin, chitin, chitosan, polygalacuronic acid, and oligogalacturonic acid), and gibellerins. Such agents are ideally compatible with the agricultural seed or seedling onto which the formulation is applied (e.g., it should not be deleterious to the growth or health of the plant). Furthermore, the agent is ideally one which does not cause safety concerns for human, animal or industrial use (e.g., no safety issues, or the compound is sufficiently labile that the commodity plant product derived from the plant contains negligible amounts of the compound).

Some examples of nematode-antagonistic biocontrol agents include ARF18; 30 *Arthrobotrys* spp.; *Chaetomium* spp.; *Cylindrocarpon* spp.; *Exophilia* spp.; *Fusarium* spp.; *Gliocladium* spp.; *Hirsutella* spp.; *Lecanicillium* spp.; *Monacrosporium* spp.; *Myrothecium* spp.; *Neocosmospora* spp.; *Paecilomyces* spp.; *Pochonia* spp.; *Stagonospora* spp.; vesicular-arbuscular mycorrhizal fungi, *Burkholderia* spp.; *Pasteuria* spp., *Brevibacillus* spp.; *Pseudomonas* spp.; and Rhizobacteria. Particularly preferred nematode-antagonistic biocontrol agents include ARF18, *Arthrobotrys oligospora, Arthrobotrys dactyloides, Chaetomium globosum, Cylindrocarpon heteronema, Exophilia jeanselmei, Exophilia pisciphila, Fusarium aspergilus, Fusarium solani, Gliocladium catenulatum, Gliocladium roseum, Gliocladium vixens, Hirsutella rhossiliensis, Hirsutella minnesotensis, Lecanicillium lecanii, Monacrosporium drechsleri, Monacrosporium gephyropagum, Myrotehcium verrucaria, Neocosmospora vasinfecta, Paecilomyces lilacinus, Pochonia chlamydosporia, Stagonospora heteroderae, Stagonospora phaseoli,* vesicular-arbuscular mycorrhizal fungi, *Burkholderia cepacia, Pasteuria penetrans, Pasteuria thornei, Pasteuria nishizawae, Pasteuria ramosa, Pastrueia usage, Brevibacillus laterosporus* strain G4, *Pseudomonas fluorescens* and Rhizobacteria.

Some examples of nutrients can be selected from the group consisting of a nitrogen fertilizer including, but not limited to Urea, Ammonium nitrate, Ammonium sulfate, Non-pressure nitrogen solutions, Aqua ammonia, Anhydrous ammonia, Ammonium thiosulfate, Sulfur-coated urea, Urea-formaldehydes, IBDU, Polymer-coated urea, Calcium nitrate, Ureaform, and Methylene urea, phosphorous fertilizers such as Diammonium phosphate, Monoammonium phosphate, Ammonium polyphosphate, Concentrated superphosphate and Triple superphosphate, and potassium fertilizers such as Potassium chloride, Potassium sulfate, Potassium-magnesium sulfate, Potassium nitrate. Such compositions can exist as free salts or ions within the seed coat composition. Alternatively, nutrients/fertilizers can be complexed or chelated to provide sustained release over time.

Some examples of rodenticides may include selected from the group of substances consisting of 2-isovalerylindan-1, 3-dione, 4-(quinoxalin-2-ylamino) benzenesulfonamide, alpha-chlorohydrin, aluminum phosphide, antu, arsenous oxide, barium carbonate, bisthiosemi, brodifacoum, bromadiolone, bromethalin, calcium cyanide, chloralose, chlorophacinone, cholecalciferol, coumachlor, coumafuryl, coumatetralyl, crimidine, difenacoum, difethialone, diphacinone, ergocalciferol, flocoumafen, fluoroacetamide, flupropadine, flupropadine hydrochloride, hydrogen cyanide, iodomethane, lindane, magnesium phosphide, methyl bromide, norbormide, phosacetim, phosphine, phosphorus, pindone, potassium arsenite, pyrinuron, scilliroside, sodium arsenite, sodium cyanide, sodium fluoroacetate, strychnine, thallium sulfate, warfarin and zinc phosphide.

In the liquid form, for example, solutions or suspensions, bacterial populations can be mixed or suspended in water or in aqueous solutions. Suitable liquid diluents or carriers include water, aqueous solutions, petroleum distillates, or other liquid carriers.

Solid compositions can be prepared by dispersing the bacterial populations in and on an appropriately divided solid carrier, such as peat, wheat, bran, vermiculite, clay, talc, bentonite, diatomaceous earth, fuller's earth, pasteurized soil, and the like. When such formulations are used as wettable powders, biologically compatible dispersing agents such as non-ionic, anionic, amphoteric, or cationic dispersing and emulsifying agents can be used.

The solid carriers used upon formulation include, for example, mineral carriers such as kaolin clay, pyrophyllite, bentonite, montmorillonite, diatomaceous earth, acid white soil, vermiculite, and pearlite, and inorganic salts such as ammonium sulfate, ammonium phosphate, ammonium nitrate, urea, ammonium chloride, and calcium carbonate. Also, organic fine powders such as wheat flour, wheat bran, and rice bran may be used. The liquid carriers include vegetable oils such as soybean oil and cottonseed oil, glycerol, ethylene glycol, polyethylene glycol, propylene glycol, polypropylene glycol, etc.

Pests

Agricultural compositions of the disclosure, which may comprise any microbe taught herein, are sometimes combined with one or more pesticides.

The pesticides that are combined with the microbes of the disclosure may target any of the pests mentioned below.

"Pest" includes but is not limited to, insects, fungi, bacteria, nematodes, mites, ticks and the like. Insect pests include insects selected from the orders Coleoptera, Diptera, Hymenoptera, Lepidoptera, Mallophaga, Homoptera, Hemiptera Orthroptera, Thysanoptera, Dermaptera, Isoptera, Anoplura, Siphonaptera, Trichoptera, etc., particularly Lepidoptera and Coleoptera.

Those skilled in the art will recognize that not all compounds are equally effective against all pests. Compounds that may be combined with microbes of the disclosure may display activity against insect pests, which may include economically important agronomic, forest, greenhouse, nursery ornamentals, food and fiber, public and animal health, domestic and commercial structure, household and stored product pests.

As aforementioned, the agricultural compositions of the disclosure (which may comprise any microbe taught herein) are in embodiments combined with one or more pesticides. These pesticides may be active against any of the following pests:

Larvae of the order Lepidoptera include, but are not limited to, armyworms, cutworms, loopers and heliothines in the family Noctuidae *Spodoptera frugiperda* J E Smith (fall armyworm); *S. exigua* Hubner (beet armyworm); *S. litura* Fabricius (tobacco cutworm, cluster caterpillar); *Mamestra configurata* Walker (bertha armyworm); *M. brassicae* Linnaeus (cabbage moth); *Agrotis ipsilon* Hufnagel (black cutworm); *A. orthogonia* Morrison (western cutworm); *A. subterranea* Fabricius (granulate cutworm); *Alabama argillacea* Hubner (cotton leaf worm); *Trichoplusia ni* Hubner (cabbage looper); *Pseudoplusia includens* Walker (soybean looper); *Anticarsia gemmatalis* Hubner (velvet bean caterpillar); *Hypena scabra* Fabricius (green clover worm); *Heliothis virescens* Fabricius (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insulana* Boisduval (spiny bollworm); *E. vittella* Fabricius (spotted bollworm); *Helicoverpa armigera* Hubner (American bollworm); *H. zea* Boddie (corn earworm or cotton bollworm); Melanchra *picta* Harris (zebra caterpillar); *Egira* (Xylomyges) *curialis* Grote (citrus cutworm); borers, case bearers, webworms, coneworms, and skeletonizers from the family Pyralidae *Ostrinia nubilalis* Hubner (European corn borer); *Amyelois transitella* Walker (naval orangeworm); Anagasta kuehniella Zeller (Mediterranean flour moth); *Cadra cautella* Walker (almond moth); *Chilo suppressalis* Walker (rice stem borer); *C. partellus*, (*sorghum* borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenee (rice leaf roller); *Desmia funeralis* Hubner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Eoreuma loftini* Dyar (Mexican rice borer); *Ephestia elutella* Hubner (tobacco (cacao) moth); *Galleria mellonella* Linnaeus (greater wax moth); *Herpetogramma licarsisalis* Walker (sod webworm); *Homoeosoma electellum* Hulst (sunflower moth); *Elasmopalpus lignosellus* Zeller (lesser cornstalk borer); *Achroia grisella* Fabricius (lesser wax moth); *Loxostege sticticalis* Linnaeus (beet webworm); *Orthaga* thyrisalis Walker (tea tree web moth); *Maruca testulalis* Geyer (bean pod borer); *Plodia interpunctella* Hubner (Indian meal moth); *Scirpophaga incertulas* Walker (yellow stem borer); *Udea rubigalis* Guenee (celery leaftier); and leafrollers, budworms, seed worms and fruit worms in the family Tortricidae *Acleris gloverana* Walsingham (Western blackheaded budworm); *A. variana* Fernald (Eastern blackheaded budworm); *Archips argyrospila* Walker (fruit tree leaf roller); *A. rosana* Linnaeus (European leaf roller); and other *Archips* species, *Adoxophyes orana* Fischer von Rosslerstamm (summer fruit *tortrix* moth); *Cochylis hospes* Walsingham (banded sunflower moth); *Cydia latiferreana* Walsingham (filbertworm); *C. pomonella* Linnaeus (colding moth); *Platynota flavedana* Clemens (variegated leafroller); *P. stultana* Walsingham (omnivorous leafroller); *Lobesia botrana* Denis & Schiffermuller (European grape vine moth); *Spilonota ocellana* Denis & Schiffermuller (eyespotted bud moth); *Endopiza viteana* Clemens (grape berry moth); *Eupoecilia ambiguella* Hubner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; *Choristoneura* spp.

Selected other agronomic pests in the order Lepidoptera include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guerin-Meneville (Chinese Oak Tussah Moth); *Bombyx mori* Linnaeus (Silkworm); *Bucculatrix thurberiella* Busck (cotton leaf perforator); *Colias eurytheme* Boisduval (alfalfa caterpillar); Datana *integerrima* Grote & Robinson (walnut caterpillar); *Dendrolimus sibiricus* Tschetwerikov (Siberian silk moth), *Ennomos subsignaria* Hubner (elm spanworm); *Erannis tiliaria* Harris (linden looper); *Euproctis chrysorrhoea* Linnaeus (browntail moth); *Harrisina americana* Guerin-Meneville (grapeleaf skeletonizer); *Hemileuca oliviae* Cockrell (range caterpillar); *Hyphantria cunea* Drury (fall web-worm); *Keiferia lycopersicella* Walsingham (tomato pinworm); *Lambdina fiscellaria* Hulst (Eastern hemlock looper); *L. fiscellaria* lugubrosa Hulst (Western hemlock looper); *Leucoma salicis* Linnaeus (satin moth); *Lymantria dispar* Linnaeus (gypsy moth); *Manduca quinquemaculata* Haworth (five spotted hawk moth, tomato hornworm); *M. sexta* Haworth (tomato homworm, tobacco hornworm); *Operophtera brumata* Linnaeus (winter moth); *Paleacrita vernata* Peck (spring cankerworm); *Papilio cresphontes* Cramer (giant swallowtail orange dog); *Phryganidia californica* Packard (California oakworm); *Phyllocnistis citrella* Stainton (citrus leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutella xylostella* Linnaeus (diamondback moth); *Pectinophora gossypiella* Saunders (pink bollworm); *Pontia protodice* Boisduval and Leconte (Southern cabbage-worm); *Sabulodes aegrotata* Guenee (onmivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothes moth); *Tuta absoluta* Meyrick (tomato leafminer); *Yponomeuta padella* Linnaeus (ermine moth); *Heliothis subflexa* Guenee; *Malacosoma* spp. and *Orgyia* spp.; *Ostrinia nubilalis* (European corn borer); seed corn maggot; *Agrotis ipsilon* (black cutworm).

Larvae and adults of the order Coleoptera including weevils from the families Anthribidae, Bruchidae and Curculionidae (including, but not limited to: *Anthonomus grandis* Boheman (boll weevil); *Lissorhoptrus oryzophilus* Kuschel (rice water weevil); *Sitophilus granarius* Linnaeus (granary weevil); *S. oryzae* Linnaeus (rice weevil); *Hypera punctata* Fabricius (clover leaf weevil); *Cylindrocopturus adspersus* LeConte (sunflower stem weevil); Smicronyx *fulvus* LeConte (red sunflower seed weevil); *S. sordidus* LeConte (gray sunflower seed weevil); *Sphenophorus maidis* Chittenden (maize billbug)); flea beetles, cucumber beetles, rootworms, leaf beetles, potato beetles and leafminers in the family Chrysomelidae (including, but not limited to: *Leptinotarsa decemlineata* Say (Colorado potato beetle); *Diabrotica virgifera* LeConte (western corn rootworm); *D. barberi* Smith and Lawrence (northern corn rootworm); *D. undecimpunctata* howardi Barber (southern corn rootworm); *Chaetocnema pulicaria* Melsheimer (corn flea beetle); *Phyllotreta cruciferae* Goeze (Crucifer flea beetle); *Phyllotreta striolata* (stripped flea beetle); *Colaspis brunnea* Fabricius (grape *colaspis*); *Oulema melanopus* Linnaeus (cereal leaf beetle); *Zygogramma exclamationis* Fabricius (sunflower beetle)); beetles from the family Coccinellidae (including, but not limited to: *Epilachna varivestis* Mulsant (Mexican bean beetle)); chafers and other beetles from the family Scarabaeidae (including, but not limited to: *Popillia japonica* Newman (Japanese beetle); *Cyclocephala borealis* Arrow (northern masked chafer, white grub); *C. immaculata* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle)); carpet beetles from the family Dermestidae; wireworms from the family Elateridae, *Eleodes* spp., *Melanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae; *Cerotoma* trifurcate (bean leaf beetle); and wireworm.

Adults and immatures of the order Diptera, including leafminers *Agromyza parvicornis* Loew (corn blotch leafminer); midges (including, but not limited to: *Contarinia sorghicola* Coquillett (*sorghum* midge); *Mayetiola destructor* Say (Hessian fly); *Sitodiplosis mosellana* Gehin (wheat midge); *Neolasioptera murtfeldtiana* Felt, (sunflower seed midge)); fruit flies (Tephritidae), *Oscinella frit* Linnaeus (fruit flies); maggots (including, but not limited to: *Delia platura* Meigen (seedcorn maggot); *D. coarctata* Fallen (wheat bulb fly) and other *Delia* spp., *Meromyza americana* Fitch (wheat stem maggot); *Musca domestica* Linnaeus (house flies); *Fannia canicularis* Linnaeus, *F. femoralis* Stein (lesser house flies); *Stomoxys calcitrans* Linnaeus (stable flies)); face flies, horn flies, blow flies, *Chrysomya* spp.; *Phormia* spp. and other muscoid fly pests, horse flies *Tabanus* spp.; bot flies Gastrophilus spp.; *Oestrus* spp.; cattle grubs *Hypoderma* spp.; deer flies *Chrysops* spp.; *Melophagus ovinus* Linnaeus (keds) and other Brachycera, mosquitoes *Aedes* spp.; *Anopheles* spp.; *Culex* spp.; black flies *Prosimulium* spp.; *Simulium* spp.; biting midges, sand flies, sciarids, and other Nematocera.

Adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, Issidae and Delphacidae, treehoppers from the family Membracidae, psyllids from the family Psyllidae, whiteflies from the family Aleyrodidae, aphids from the family Aphididae, *phylloxera* from the family Phylloxeridae, mealybugs from the family Pseudococcidae, scales from the families Asterolecanidae, Coccidae, Dactylopiidae, Diaspididae, Eriococcidae Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family Coreidae and red bugs and cotton stainers from the family Pyrrhocoridae.

Agronomically important members from the order Homoptera further include, but are not limited to: *Acyrthisiphon pisum* Harris (pea aphid); *Aphis craccivora* Koch (cowpea aphid); *A. fabae* Scopoli (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacorthum solani* Kaltenbach (foxglove aphid); *Chaetosiphon fragaefolii* Cockerell (strawberry aphid); *Diuraphis noxia* Kurdjumov/Mordvilko (Russian wheat aphid); *Dysaphis plantaginea* Paaserini (rosy apple aphid); *Eriosoma lanigerum* Hausmann (woolly apple aphid); *Brevicoryne brassicae* Linnaeus (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach potato aphid, green peach aphid); *Nasonovia ribisnigri* Mosley (lettuce aphid); Pemphigus spp. (root aphids and gall aphids); *Rhopalosiphum maidis* Fitch (corn leaf aphid); *R. padi* Linnaeus (bird cherry-oat aphid); *Schizaphis graminum* Rondani (greenbug); *Sipha flava* Forbes (yellow sugarcane aphid); *Sitobion avenae* Fabricius (English grain aphid); *Therioaphis maculata* Buckton (spotted alfalfa aphid); *Toxoptera aurantii* Boyer de Fonscolombe (black citrus aphid) and *T. citricida* Kirkaldy (brown citrus aphid); *Melanaphis sacchari* (sugarcane aphid); *Adelges* spp. (adelgids); *Phylloxera devastatrix* Pergande (pecan *phylloxera*); *Bemisia tabaci* Gennadius (tobacco whitefly, sweetpotato whitefly);

*B. argentifolii* Bellows & Perring (silverleaf whitefly); *Dialeurodes citri* Ashmead (citrus whitefly); *Trialeurodes abutiloneus* (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrolestes quadrilineatus* Forbes (aster leafhopper); *Nephotettix cinticeps* Uhler (green leafhopper); *N. nigropictus* Stal (rice leafhopper); *Nilaparvata lugens* Stal (brown planthopper); *Peregrinus maidis* Ashmead (corn planthopper); *Sogatella furcifera* Horvath (white backed planthopper); *Sogatodes orizicola* Muir (rice delphacid); *Typhlocyba pomaria* McAtee (white apple leafhopper); *Erythroneoura* spp. (grape leafhoppers); Magicicada *septendecim* Linnaeus (periodical cicada); *Icerya purchasi* Maskell (cottony cushion scale); *Quadraspidiotus perniciosus* Comstock (San Jose scale); *Planococcus citri* Risso (citrus mealybug); Pseudococcus spp. (other mealybug complex); *Cacopsylla pyricola* Foerster (pear *psylla*); *Trioza diospyri* Ashmead (persimmon *psylla*).

Species from the order Hemiptera include, but are not limited to: *Acrosternum hilare* Say (green stink bug); *Anasa tristis* De Geer (squash bug); *Blissus leucopterus* Say (chinch bug); *Corythuca gossypii* Fabricius (cotton lace bug); *Cyrtopeltis modesta* Distant (tomato bug); *Dysdercus suturellus* Herrich-Schaffer (cotton stainer); *Euschistus servus* Say (brown stink bug); *E. variolarius* Palisot de Beauvais (one spotted stink bug); *Graptostethus* spp. (complex of seed bugs); *Leptoglossus corculus* Say (leaf footed pine seed bug); *Lygus lineolaris* Palisot de Beauvais (tarnished plant bug); *L. Hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milk-weed bug); *Pseudatomoscelis seriatus* Reuter (cotton flea hopper).

Hemiptera such as, *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); *Adelphocoris rapidus* Say (rapid plant bug); *Poecilocapsus lineatus* Fabricius (four lined plant bug); *Nysius ericae* Schilling (false chinch bug); *Nysius raphanus* Howard (false chinch bug); *Nezara viridula* Linnaeus (Southern green stink bug); *Eurygaster* spp.; *Coreidae* spp.; *Pyrrhocoridae* spp.; *Tinidae* spp.; *Blostomatidae* spp.; *Reduviidae* spp. and *Cimicidae* spp.

Adults and larvae of the order Acari (mites) such as *Aceria tosichella* Keifer (wheat curl mite); *Petrobia latens* Muller (brown wheat mite); spider mites and red mites in the family Tetranychidae, *Panonychus ulmi* Koch (European red mite); *Tetranychus urticae* Koch (two spotted spider mite); (*T. mcdanieli* McGregor (McDaniel mite); *T. cinnabarinus* Boisduval (carmine spider mite); *T. turkestani* Ugarov & Nikolski (strawberry spider mite); flat mites in the family Tenuipalpidae, *Brevipalpus lewisi* McGregor (citrus flat mite); rust and bud mites in the family Eriophyidae and other foliar feeding mites and mites important in human and animal health, i.e., dust mites in the family Epidermoptidae, follicle mites in the family Demodicidae, grain mites in the family Glycyphagidae, ticks in the order Ixodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick) and scab and itch mites in the families Psoroptidae, Pyemotidae and Sarcoptidae.

Insect pests of the order Thysanura, such as *Lepisma saccharina* Linnaeus (silverfish); *Thermobia domestica* Packard (firebrat).

Additional arthropod pests include: spiders in the order Araneae such as *Loxosceles reclusa* Gertsch and Mulaik (brown recluse spider) and the *Latrodectus mactans* Fabricius (black widow spider) and centipedes in the order Scutigeromorpha such as *Scutigera coleoptrata* Linnaeus (house centipede).

Superfamily of stink bugs and other related insects including but not limited to species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus,* and *Bagrada hilaris* (*Bagrada* Bug)), the family Plataspidae (*Megacopta cribraria*—Bean plataspid) and the family Cydnidae (*Scaptocoris castanea*-Root stink bug) and Lepidoptera species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hubner.

Nematodes include parasitic nematodes such as root-knot, cyst and lesion nematodes, including *Heterodera* spp., *Meloidogyne* spp. and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode) and *Globodera rostochiensis* and *Globodera pailida* (potato cyst nematodes). Lesion nematodes include *Pratylenchus* spp.

Pesticidal Compositions Comprising a Pesticide and Microbe of the Disclosure

As aforementioned, agricultural compositions of the disclosure, which may comprise any microbe taught herein, are sometimes combined with one or more pesticides. Pesticides can include herbicides, insecticides, fungicides, nematicides, etc.

In some embodiments, the pesticides/microbial combinations can be applied in the form of compositions and can be applied to the crop area or plant to be treated, simultaneously or in succession, with other compounds. These compounds can be fertilizers, weed killers, cryoprotectants, surfactants, detergents, pesticidal soaps, dormant oils, polymers, and/or time release or biodegradable carrier formulations that permit long term dosing of a target area following a single application of the formulation. They can also be selective herbicides, chemical insecticides, virucides, microbicides, amoebicides, pesticides, fungicides, bacteriocides, nematicides, molluscicides or mixtures of several of these preparations, if desired, together with further agriculturally acceptable carriers, surfactants or application promoting adjuvants customarily employed in the art of formulation. Suitable carriers (i.e. agriculturally acceptable carriers) and adjuvants can be solid or liquid and correspond to the substances ordinarily employed in formulation technology, e.g. natural or regenerated mineral substances, solvents, dispersants, wetting agents, sticking agents, tackifiers, binders or fertilizers. Likewise, the formulations may be prepared into edible baits or fashioned into pest traps to permit feeding or ingestion by a target pest of the pesticidal formulation.

Exemplary chemical compositions, which may be combined with the microbes of the disclosure, include:

Fruits/Vegetables Herbicides: Atrazine, Bromacil, Diuron, Glyphosate, Linuron, Metribuzin, Simazine, Trifluralin, Fluazifop, Glufosinate, Halo sulfuron Gowan, Paraquat, Propyzamide, Sethoxydim, Butafenacil, Halosulfuron, Indaziflam; Fruits/Vegetables Insecticides: Aldicarb, *Bacillus thuringiensis*, Carbaryl, Carbofuran, Chlorpyrifos, Cypermethrin, Deltamethrin, Diazinon, Malathion, Abamectin, Cyfluthrin/betacyfluthrin, Esfenvalerate, Lambda-cyhalothrin, Acequinocyl, Bifenazate, Methoxyfenozide, Novaluron, Chromafenozide, Thiacloprid, Dinotefuran, FluaCrypyrim, Tolfenpyrad, Clothianidin, Spirodiclofen, Gamma-cyhalothrin, Spiromesifen, Spinosad, Rynaxypyr, Cyazypyr, Spinoteram, Triflumuron, Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinotoram, Thiodicarb, Flonicamid, Methiocarb, Emamectin benzoate, Indoxacarb, Forthiazate, Fenamiphos, Cadusaphos, Pyriproxifen, Fenbutatin oxide, Hexthiazox, Methomyl, 4-[[(6-Chlorpyridin-3-yl)methyl](2, 2-difluorethyl)amino]furan-2 (5H)-on; Fruits Vegetables Fungicides: Carbendazim, Chlorothalonil, EBDCs, Sulphur, Thiophanate-methyl, Azoxystrobin, Cymoxanil, Fluazinam, Fosetyl, Iprodione, Kresoximmethyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Picoxystrobin, Pyraclostrobin, Cyflufenamid, Boscalid;

Cereals Herbicides: Isoproturon, Bromoxynil, loxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, Iodosulfuron, Propoxycarbazone, Picolin-afen, Mesosulfuron, Beflubutamid, Pinoxaden, Amidosulfuron, Thifensulfuron Methyl, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoxim-methyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lambda-cyhalothrin, Deltamethrin, alpha-Cypermethrin, β-cyfluthrin, Bifenthrin, Imidacloprid, Clothianidin, Thiamethoxam, Thiacloprid, Acetamiprid, Dinetofuran, Clorphyriphos, Metamidophos, Oxidemethon methyl, Pirimicarb, Methiocarb;

Maize Herbicides: Atrazine, Alachlor, Bromoxynil, Acetochlor, Dicamba, Clopyralid, S-Dimethenamid, Glufosinate, Glyphosate, Isoxaflutole, S-Metolachlor, Mesotrione, Nicosulfuron, Primisulfuron, Rimsulfuron, Sulcotrione, Foramsulfuron, Topramezone, Tembotrione, Saflufenacil, Thiencarbazone, Flufenacet, Pyroxasulfon; Maize Insecticides: Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumoron, Tefluthrin, Tebupirim-phos, Ethiprole, Cyazypyr, Thiacloprid, Acetamiprid, Dinetofuran, Avermectin, Methiocarb, Spirodiclofen, Spirotetramat; Maize Fungicides: Fenitropan, Thiram, Prothioconazole, Tebuconazole, Trifloxystrobin;

Rice Herbicides: Butachlor, Propanil, Azimsulfuron, Bensulfuron, Cyhalo-fop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides: Diazinon, Fenitro-thion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofen-prox, Triazophos, 4-[[(6-Chlorpyridin-3-yl)methyl] (2,2-difluorethyl)amino]furan-2 (5H)-on, Carbofuran, Benfuracarb; Rice Fungicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil;

Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinetofuran, Flubendiamide, Cyazypyr, Spinosad, Spinotoram, gamma Cyhalothrin, 4-[[(6-Chlorpyridin-3-yl) methyl](2,2-difluorethyl)amino]furan-2 (5H)-on, Thiodicarb, Avermectin, Flonicamid, Pyridalyl, Spiromesifen, Sulfoxaflor, Profenophos, Thriazophos, Endosulfan; Cotton Fungicides: Etridiazole, Metalaxyl, Quintozene;

Soybean Herbicides: Alachlor, Bentazone, Trifluralin, Chlorimuron-Ethyl, Cloransulam-Methyl, Fenoxaprop, Fomesafen, Flu-azifop, Glyphosate, Imazamox, Imazaquin, Imazethapyr, (S-)Metolachlor, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinetofuran, Flubendiamide, Rynaxypyr, Cyazypyr, Spinosad, Spinotoram, Emamectin-Benzoate, Fipronil, Ethiprole, Deltamethrin, β-Cyfluthrin, gamma and lambda Cyhalothrin, 4-[[(6-Chlorpyridin-3-yl)methyl](2,2-difluorethyl)amino]furan-2 (5H)-on, Spirotetramat, Spinodiclofen, Triflumuron, Flonicamid, Thiodicarb, beta-Cyfluthrin; Soybean Fungicides: Azoxystrobin, Cyproconazole, Epoxiconazole, Flutriafol, Pyraclostrobin, Tebuconazole, Trifloxystrobin, Prothioconazole, Tetraconazole;

Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepral-oxydim, Quizalofop; Sugarbeet Insecticides: Imidacloprid, Clothianidin, Thiamethoxam, Thiacloprid, Acetamiprid, Dinetofuran, Deltamethrin, β-Cyfluthrin, gamma/lambda Cyhalothrin, 4-[[(6-Chlorpyridin-3-yl) methyl](2,2-difluor-ethyl)amino]furan-2 (5H)-on, Tefluthrin, Rynaxypyr, Cyaxypyr, Fipronil, Carbofuran;

Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides: Azoxystrobin, Carbendazim, Fludioxonil, Iprodione, Prochloraz, Vinclozolin; Canola Insecticides: Carbofuran organophosphates, Pyrethroids, Thiacloprid, Deltamethrin, Imidacloprid, Clothianidin, Thiamethoxam, Acetamiprid, Dineto-furan, β-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl)methyl](2,2-difluorethyl) amino]furan-2 (5H)-on.

Insecticidal Compositions Comprising an Insecticide and Microbe of the Disclosure As aforementioned, agricultural compositions of the disclosure, which may comprise any microbe taught herein, are sometimes combined with one or more insecticides.

In some embodiments, insecticidal compositions may be included in the compositions set forth herein, and can be applied to a plant(s) or a part(s) thereof simultaneously or in succession, with other compounds. Insecticides include ammonium carbonate, aqueous potassium silicate, boric acid, copper sulfate, elemental sulfur, lime sulfur, sucrose octanoate esters, 4-[[(6-Chlorpyridin-3-yl)methyl](2, 2-difluorethyl)amino]furan-2 (5H)-on, abamectin, notenone, fenazaquin, fenpyroximate, pyridaben, pyrimedifen, tebufenpyrad, tolfenpyrad, acephate, emamectin benzoate, lepimectin, milbemectin, hdroprene, kinoprene, methoprene, fenoxycarb, pyriproxyfen, methryl bromide and other alkyl halides, fulfuryl fluoride, chloropicrin, borax, disodium octaborate, sodium borate, sodium metaborate, tartar emetic, dazomet, metam, pymetrozine, pyrifluquinazon, flofentezine, diflovidazin, hexythiazox, bifenazate, thiamethoxam, imidacloprid, fenpyroximate, azadirachtin, permethrin, esfenvalerate, acetamiprid, bifenthrin, indoxacarb, azadirachtin, pyrethrin, imidacloprid, beta-cyfluthrin, sulfotep, tebupirimfos, temephos, terbufos, tetrachlorvinphos, thiometon, triazophos, alanycarb, aldicarb, bendiocarb, benfluracarb, butocarboxim, butoxycarboxim, carbaryl, carbofuran, carbosulfan, ethiofencarb, fenobucarb, formetanate, furathiocarb, isoprocarb, methiocarb, methymyl, metolcarb, oxamyl, primicarb, propoxur, thiodicarb, thiofanox, triazamate, trimethacarb, XMC, xylylcarb, acephate, azamethiphos, azinphos-ethyl, azinphos-methyl, cadusafos, chlorethoxyfox, trichlorfon, vamidothion, chlordane, endosulfan, ethiprole, fipronil, acrinathrin, allethrin, bifenthrin, bioallethrin, bioalletherin X-cyclopentenyl, bioresmethrin, cyclorothrin, cyfluthrin, cyhalothrin, cypermethrin, cyphenothrin [(1R)-trans-isomers], deltamethrin, empenthrin [(EZ)-(1R)-isomers], esfenvalerate, etofenprox, fenpropathrin, fenvalerate, flucythrinate, flumethrin, halfenprox, kadathrin, phenothrin [(1R)-trans-isomer] prallethrin, pyrethrins (pyrethrum), resmethrin, silafluofen, tefluthrin, tetramethrin, tetramethrin [(1R)-isomers], tralomethrin, transfluthrin, alpha-cypermethrin, beta-cyfluthrin, beta-cypermethrin, d-cis-trans allethrin, d-trans allethrin, gamma-cyhalothrin, lamda-cyhalothrin, tau-fluvalinate, theta-cypermethrin, zeta-cypermethrin, methoxychlor, nicotine, sulfoxaflor, acetamiprid, clothianidin, dinotefuran, imidacloprid, nitenpyram, thiacloprid, thiamethoxan, tebuprimphos, betacyfluthrin, clothianidin, flonicamid, hydramethylnon, amitraz, flubendiamide, blorantraniliprole, lambda cyhalothrin, spinosad, gamma cyhalothrin, *Beauveria bassiana, capsicum* oleoresin extract, garlic oil, carbaryl, chlorpyrifos, sulfoxaflor, lambda cyhalothrin, Chlorfenvinphos, Chlormephos, Chlorpyrifos, Chlorpyrifos-methyl, Coumaphos, Cyanophos, Demeton-S-methyl, Diazinon, Dichlorvos/DDVP, Dicrotophos, Dimethoate, Dimethylvinphos, Disulfoton, EPN, Ethion, Ethoprophos, Famphur, Fenamiphos, Fenitrothion, Fenthion, Fosthiazate, Heptenophos, Imicyafos, Isofenphos, Isopropyl O-(methoxyaminothio-phosphoryl) salicylate, Isoxathion, Malathion, Mecarbam, Methamidophos, Methidathion, Mevinphos, Monocrotophos, Naled, Omethoate, Oxydemeton-methyl, Parathion, Parathionmethyl, Phenthoate, Phorate, Phosalone, Phosmet, Phosphamidon, Phoxim, Pirimiphos-methyl, Profenofos, Propetamphos, Prothiofos, Pyraclofos, Pyridaphenthion, Quinalphosfluacrypyrim, tebufenozide, chlorantraniliprole, *Bacillus thuringiensis* subs. Kurstaki, terbufos, mineral oil, fenpropathrin, metaldehyde, deltamethrin, diazinon, dimethoate, diflubenzuron, pyriproxyfen, reosemary oil, peppermint oil, geraniol, azadirachtin, piperonyl butoxide, cyantraniliprole, alpha cypermethrin, tefluthrin, pymetrozine, malathion, *Bacillus thuringiensis* subsp. *israelensis*, dicofol, bromopropylate, benzoximate, azadirachtin, flonicamid, soybean oil, *Chromobacterium subtsugae* strain PRAA4-1, zeta cypermethrin, phosmet, methoxyfenozide, paraffinic oil, spirotetramat, methomyl, Metarhizium anisopliae strain F52, ethoprop, tetradifon, propargite, fenbutatin oxide, azocyclotin, cyhexatin, diafenthiuron, *Bacillus sphaericus*, etoxazole, flupyradifurone, azadirachtin, *Beauveria bassiana*, cyflumetofen, azadirachtin, chinomethionat, acephate, Isaria fumosorosea Apopka strain 97, sodium tetraborohydrate decahydrate, emamectin benzoate, cryolite, spinetoram, *Chenopodium ambrosioides* extract, novaluron, dinotefuran, carbaryl, acequinocyl, flupyradifurone, iron phosphate, kaolin, buprofezin, cyromazine, chromafenozide, halofenozide, methoxyfenozide, tebufenozide, bistrifluron, chlorfluazuron, diflubenzuron, flucycloxuron, flufenoxuron, hexaflumuron, lufenuron, nocaluron, noviflumuron, teflubenzuron, triflumuron, bensultap, cartap hydrochloride, thiocyclam, thiosultap-sodium, DNOC, chlorfenapyr, sulfuramid, phorate, tolfenpyrad, sulfoxaflor, neem oil, *Bacillus thuringiensis* subsp. *tenebrionis* strain SA-10, cyromazine, heat-killed *Burkholderia* spp., cyantraniliprole, cyenopyrafen, cyflumetofen, sodium cyanide, potassium cyanide, calcium cyanide, aluminum phosphide, calcium phosphide, phosphine, zinc phosphide, spriodiclofen, spiromesifen, spirotetramat, metaflumizone, flubendiamide, pyflubumide, oxamyl, *Bacillus thuringiensis* subsp. *aizawai*, etoxazole, and esfenvalerate

TABLE 9

| Exemplary insecticides associated with various modes of action, which can be combined with microbes of the disclosure | | | |
|---|---|---|---|
| Mode of Action | Compound class | Exemplary insecticides | Physiological function(s) affected |
| acetylcholinesterase (AChE) inhibitors | carbamates | Alanycarb, Aldicarb, Bendiocarb, Benfuracarb, Butocarboxim, Butoxycarboxim, Carbaryl, Carbofuran, Carbosulfan, Ethiofencarb, Fenobucarb, Formetanate, Furathiocarb, Isoprocarb, Methiocarb, Methomyl, Metolcarb, Oxamyl, Pirimicarb, Propoxur, Thiodicarb, Thiofanox, Triazamate, Trimethacarb, XMC, Xylylcarb | Nerve and muscle |
| acetylcholinesterase (AChE) inhibitors | organophosphates | Acephate, Azamethiphos, Azinphos-ethyl, Azinphos-methyl, Cadusafos, Chlorethoxyfos, Chlorfenvinphos, Chlormephos, Chlorpyrifos, Chlorpyrifos-methyl, Coumaphos, Cyanophos, Demeton-S-methyl, Diazinon, Dichlorvos/DDVP, Dicrotophos, Dimethoate, Dimethylvinphos, Disulfoton, EPN, Ethion, Ethoprophos, Famphur, Fenamiphos, Fenitrothion, Fenthion, Fosthiazate, Heptenophos, Imicyafos, Isofenphos, Isopropyl O-(methoxyaminothio-phosphoryl) salicylate, Isoxathion, Malathion, Mecarbam, Methamidophos, Methidathion, Mevinphos, Monocrotophos, Naled, Omethoate, Oxydemeton-methyl, Parathion, Parathion-methyl, Phenthoate, Phorate, Phosalone, Phosmet, Phosphamidon, Phoxim, Pirimiphos-methyl, Profenofos, Propetamphos, Prothiofos, Pyraclofos, Pyridaphenthion, Quinalphos, Sulfotep, Tebupirimfos, Temephos, Terbufos, Tetrachlorvinphos, Thiometon, | Nerve and muscle |

TABLE 9-continued

Exemplary insecticides associated with various modes of action,
which can be combined with microbes of the disclosure

| Mode of Action | Compound class | Exemplary insecticides | Physiological function(s) affected |
|---|---|---|---|
| | | Triazophos, Trichlorfon, Vamidothion | |
| GABA-gated chloride channel blockers | cyclodiene organochlorines | Chlordane, Endosulfan | Nerve and muscle |
| GABA-gated chloride channel blockers | phenylpyrazoles (Fiproles) | Ethiprole, Fipronil | Nerve and muscle |
| sodium channel modulators | pyrethroids, pyrethrins | Acrinathrin, Allethrin, Bifenthrin, Bioallethrin, Bioallethrin S-cyclopentenyl, Bioresmethrin, Cycloprothrin, Cyfluthrin, Cyhalothrin, Cypermethrin, Cyphenothrin [(1R)-trans-isomers], Deltamethrin, Empenthrin [(EZ)-(1R)-isomers], Esfenvalerate, Etofenprox, Fenpropathrin, Fenvalerate, Flucythrinate, Flumethrin, Halfenprox, Kadathrin, Phenothrin [(1R)-trans-isomer], Prallethrin, Pyrethrins (pyrethrum), Resmethrin, Silafluofen, Tefluthrin, Tetramethrin, Tetramethrin [(1R)-isomers], Tralomethrin, Transfluthrin, alpha-Cypermethrin, beta-Cyfluthrin, beta-Cypermethrin, d-cis-trans Allethrin, d-trans Allethrin, gamma-Cyhalothrin, lambda-Cyhalothrin, tau-Fluvalinate, theta-Cypermethrin, zeta-Cypermethrin | Nerve and muscle |
| sodium channel modulators | DDT, methoxychlor | DDT, methoxychlor | Nerve and muscle |
| nicotinic acetylcholine receptor (nAChR) competitive modulators | neonicotinoids | Acetamiprid, Clothianidin, Dinotefuran, Imidacloprid, Nitenpyram, Thiacloprid, Thiamethoxam | Nerve and muscle |
| nicotinic acetylcholine receptor (nAChR) competitive modulators | nicotine | nicotine | Nerve and muscle |
| nicotinic acetylcholine receptor (nAChR) competitive modulators | sulfoximines | sulfoxaflor | Nerve and muscle |
| nicotinic acetylcholine receptor (nAChR) competitive modulators | butenolides | Flupyradifurone | Nerve and muscle |
| nicotinic acetylcholine receptor (nAChR) allosteric modulators | spinosyns | Spinetoram, Spinosad | Nerve and muscle |
| Glutamate-gated chloride channel (GluCl) allosteric modulators | avermectins, milbemycins | Abamectin, Emamectin benzoate, Lepimectin, Milbemectin | Nerve and muscle |
| juvenile hormone mimics | juvenile hormone analogues | Hydroprene, Kinoprene, Methoprene | Growth |
| juvenile hormone mimics | Fenoxycarb | Fenoxycarb | Growth |
| juvenile hormone mimics | Pyriproxyfen | Pyriproxyfen | Growth |

TABLE 9-continued

Exemplary insecticides associated with various modes of action,
which can be combined with microbes of the disclosure

| Mode of Action | Compound class | Exemplary insecticides | Physiological function(s) affected |
|---|---|---|---|
| miscellaneous non-specific (multi-site) inhibitors | alkyl halides | Methyl bromide and other alkyl halides | Unknown or non-specific |
| miscellaneous non-specific (multi-site) inhibitors | Chloropicrin | Chloropicrin | Unknown or non-specific |
| miscellaneous non-specific (multi-site) inhibitors | fluorides | Cryolite, sulfuryl fluoride | Unknown or non-specific |
| miscellaneous non-specific (multi-site) inhibitors | borates | Borax, Boric acid, Disodium octaborate, Sodium borate, Sodium metaborate | Unknown or non-specific |
| miscellaneous non-specific (multi-site) inhibitors | tartar emetic | tartar emetic | Unknown or non-specific |
| miscellaneous non-specific (multi-site) inhibitors | methyl isothiocyanate generators | Dazomet, Metam | Unknown or non-specific |
| modulators of chordotonal organs | Pyridine azomethine derivatives | Pymetrozine, Pyrifluquinazon | Nerve and muscle |
| mite growth inhibitors | Clofentezine, Diflovidazin, Hexythiazox | Clofentezine, Diflovidazin, Hexythiazox | Growth |
| mite growth inhibitors | Etoxazole | Etoxazole | Growth |
| microbial disruptors of insect midgut membranes | *Bacillus thuringiensis* and the insecticidal proteins they produce | Bt var. *aizawai*, Bt var. *israelensis*, Bt var. *kurstaki*, Bt var. *tenebrionensis* | Midgut |
| microbial disruptors of insect midgut membranes | *Bacillus sphaericus* | *Bacillus sphaericus* | Midgut |
| inhibitors of mitochondrial ATP synthase | Diafenthiuron | Diafenthiuron | Respiration |
| inhibitors of mitochondrial ATP synthase | organotin miticides | Azocyclotin, Cyhexatin, Fenbutatin oxide | Respiration |
| inhibitors of mitochondrial ATP synthase | Propargite | Propargite | Respiration |
| inhibitors of mitochondrial ATP synthase | Tetradifon | Tetradifon | Respiration |
| uncouplers of oxidative phosphorylation via disruption of the proton gradient | Chlorfenapyr, DNOC, Sulfuramid | Chlorfenapyr, DNOC, Sulfuramid | Respiration |
| Nicotinic acetylcholine receptor (nAChR) channel blockers | nereistoxin analogues | Bensultap, Cartap hydrochloride, Thiocyclam, Thiosultap-sodium | Nerve and muscle |
| inhibitors of chitin biosynthesis, type 0 | benzoylureas | Bistrifluron, Chlorfluazuron, Diflubenzuron, Flucycloxuron, Flufenoxuron, Hexaflumuron, Lufenuron, Novaluron, Noviflumuron, Teflubenzuron, Triflumuron | Growth |
| inhibitors of chitin biosynthesis, type 1 | Buprofezin | Buprofezin | Growth |
| moulting disruptor, Dipteran | Cyromazine | Cyromazine | Growth |
| ecdysone receptor agonists | diacylhydrazines | Chromafenozide, Halofenozide, Methoxyfenozide, Tebufenozide | Growth |

TABLE 9-continued

Exemplary insecticides associated with various modes of action,
which can be combined with microbes of the disclosure

| Mode of Action | Compound class | Exemplary insecticides | Physiological function(s) affected |
|---|---|---|---|
| octopamine receptor agonists | Amitraz | Amitraz | Nerve and muscle |
| mitochondrial complex III electron transport inhibitors | Hydramethylnon | Hydramethylnon | Respiration |
| mitochondrial complex III electron transport inhibitors | Acequinocyl | Acequinocyl | Respiration |
| mitochondrial complex III electron transport inhibitors | Fluacrypyrim | Fluacrypyrim | Respiration |
| mitochondrial complex III electron transport inhibitors | Bifenazate | Bifenazate | Respiration |
| mitochondrial complex I electron transport inhibitors | Meti acaricides and insecticides | Fenazaquin, Fenpyroximate, Pyridaben, Pyrimidifen, Tebufenpyrad, Tolfenpyrad | Respiration |
| mitochondrial complex I electron transport inhibitors | Rotenone | Rotenone | Respiration |
| voltage-dependent sodium channel blockers | oxadiazines | Indoxacarb | Nerve and muscle |
| voltage-dependent sodium channel blockers | semicarbazones | Metaflumizone | Nerve and muscle |
| inhibitors of acetyl CoA carboxylase | tetronic and tetramic acid derivatives | Spirodiclofen, Spiromesifen, Spirotetramat | Growth |
| mitochondrial complex IV electron transport inhibitors | phosphides | Aluminium phosphide, Calcium phosphide, Phosphine, Zinc phosphide | Respiration |
| mitochondrial complex IV electron transport inhibitors | cyanides | Calcium cyanide, Potassium cyanide, Sodium cyanide | Respiration |
| mitochondrial complex II electron transport inhibitors | beta-ketonitrile derivatives | Cyenopyrafen, Cyflumetofen | Respiration |
| mitochondrial complex II electron transport inhibitors | carboxanilides | Pyflubumide | Respiration |
| ryanodine receptor modulators | diamides | Chlorantraniliprole, Cyantraniliprole, Flubendiamide | Nerve and muscle |
| Chordotonal organ modulators - undefined target site | Flonicamid | Flonicamid | Nerve and muscle |
| compounds of unknown or uncertain mode of action | Azadirachtin | Azadirachtin | Unknown |
| compounds of unknown or uncertain mode of action | Benzoximate | Benzoximate | Unknown |
| compounds of unknown or uncertain mode of action | Bromopropylate | Bromopropylate | Unknown |
| compounds of unknown or uncertain mode of action | Chinomethionat | Chinomethionat | Unknown |

TABLE 9-continued

Exemplary insecticides associated with various modes of action,
which can be combined with microbes of the disclosure

| Mode of Action | Compound class | Exemplary insecticides | Physiological function(s) affected |
|---|---|---|---|
| compounds of unknown or uncertain mode of action | Dicofol | Dicofol | Unknown |
| compounds of unknown or uncertain mode of action | lime sulfur | lime sulfur | Unknown |
| compounds of unknown or uncertain mode of action | Pyridalyl | Pyridalyl | Unknown |
| compounds of unknown or uncertain mode of action | sulfur | sulfur | Unknown |

TABLE 10

Exemplary list of pesticides, which can be
combined with microbes of the disclosure

| Category | Compounds |
|---|---|
| INSECTICIDES | |
| arsenical insecticides | calcium arsenate |
| | copper acetoarsenite |
| | copper arsenate |
| | lead arsenate |
| | potassium arsenite |
| | sodium arsenite |
| botanical insecticides | allicin |
| | anabasine |
| | azadirachtin |
| | carvacrol |
| | d-limonene |
| | matrine |
| | nicotine |
| | nornicotine |
| | oxymatrine |
| | pyrethrins |
| | cinerins |
| | cinerin I |
| | cinerin II |
| | jasmolin I |
| | jasmolin II |
| | pyrethrin I |
| | pyrethrin II |
| | quassia |
| | rhodojaponin-III |
| | rotenone |
| | ryania |
| | sabadilla |
| | sanguinarine |
| | triptolide |
| carbamate insecticides | bendiocarb |
| | carbaryl |
| benzofuranyl methylcarbamate insecticides | benfuracarb |
| | carbofuran |
| | carbosulfan |
| | decarbofuran |
| | furathiocarb |
| dimethylcarbamate insecticides | dimetan |
| | dimetilan |
| | hyquincarb |
| | isolan |
| | pirimicarb |
| | pyramat |
| | pyrolan |

TABLE 10-continued

Exemplary list of pesticides, which can be
combined with microbes of the disclosure

| Category | Compounds |
|---|---|
| oxime carbamate insecticides | alanycarb |
| | aldicarb |
| | aldoxycarb |
| | butocarboxim |
| | butoxycarboxim |
| | methomyl |
| | nitrilacarb |
| | oxamyl |
| | tazimcarb |
| | thiocarboxime |
| | thiodicarb |
| | thiofanox |
| phenyl methylcarbamate insecticides | allyxycarb |
| | aminocarb |
| | bufencarb |
| | butacarb |
| | carbanolate |
| | cloethocarb |
| | CPMC |
| | dicresyl |
| | dimethacarb |
| | dioxacarb |
| | EMPC |
| | ethiofencarb |
| | fenethacarb |
| | fenobucarb |
| | isoprocarb |
| | methiocarb |
| | metolcarb |
| | mexacarbate |
| | promacyl |
| | promecarb |
| | propoxur |
| | trimethacarb |
| | XMC |
| | xylylcarb |
| diamide insecticides | broflanilide |
| | chlorantraniliprole |
| | cyantraniliprole |
| | cyclaniliprole |
| | cyhalodiamide |
| | flubendiamide |
| | tetraniliprole |

TABLE 10-continued

Exemplary list of pesticides, which can be
combined with microbes of the disclosure

| Category | Compounds |
|---|---|
| dinitrophenol insecticides | dinex |
| | dinoprop |
| | dinosam |
| | DNOC |
| fluorine insecticides | barium hexafluorosilicate |
| | cryolite |
| | flursulamid |
| | sodium fluoride |
| | sodium hexafluorosilicate |
| | sulfluramid |
| formamidine insecticides | amitraz |
| | chlordimeform |
| | formetanate |
| | formparanate |
| | medimeform |
| | semiamitraz |
| fumigant insecticides | acrylonitrile |
| | carbon disulfide |
| | carbon tetrachloride |
| | carbonyl sulfide |
| | chloroform |
| | chloropicrin |
| | cyanogen |
| | para-dichlorobenzene |
| | 1,2-dichloropropane |
| | dithioether |
| | ethyl formate |
| | ethylene dibromide |
| | ethylene dichloride |
| | ethylene oxide |
| | hydrogen cyanide |
| | methyl bromide |
| | methyl iodide |
| | methylchloroform |
| | methylene chloride |
| | naphthalene |
| | phosphine |
| | sodium tetrathiocarbonate |
| | sulfuryl fluoride |
| | tetrachloroethane |
| inorganic insecticides | borax |
| | boric acid |
| | calcium polysulfide |
| | copper oleate |
| | diatomaceous earth |
| | mercurous chloride |
| | potassium thiocyanate |
| | silica gel |
| | sodium thiocyanate |
| insect growth regulators | |
| chitin synthesis inhibitors | buprofezin |
| | cyromazine |
| benzoylphenylurea chitin synthesis inhibitors | bistrifluron |
| | chlorbenzuron |
| | chlorfluazuron |
| | dichlorbenzuron |
| | diflubenzuron |
| | flucycloxuron |
| | flufenoxuron |
| | hexaflumuron |
| | lufenuron |
| | novaluron |
| | noviflumuron |
| | penfluron |
| | teflubenzuron |
| | triflumuron |
| juvenile hormone mimics | dayoutong |
| | epofenonane |
| | fenoxycarb |
| | hydroprene |
| | kinoprene |
| | methoprene |
| | pyriproxyfen |
| | triprene |

TABLE 10-continued

Exemplary list of pesticides, which can be
combined with microbes of the disclosure

| Category | Compounds |
|---|---|
| juvenile hormones | juvenile hormone I |
| | juvenile hormone II |
| | juvenile hormone III |
| moulting hormone agonists | chromafenozide |
| | furan tebufenozide |
| | halofenozide |
| | methoxyfenozide |
| | tebufenozide |
| | yishijing |
| moulting hormones | α-ecdysone |
| | ecdysterone |
| moulting inhibitors | diofenolan |
| precocenes | precocene I |
| | precocene II |
| | precocene III |
| unclassified insect growth regulators | dicyclanil |
| macrocyclic lactone insecticides | |
| avermectin insecticides | abamectin |
| | doramectin |
| | emamectin |
| | eprinomectin |
| | ivermectin |
| | selamectin |
| milbemycin insecticides | lepimectin |
| | milbemectin |
| | milbemycin oxime |
| | moxidectin |
| spinosyn insecticides | spinetoram |
| | spinosad |
| neonicotinoid insecticides | |
| nitroguanidine neonicotinoid insecticides | clothianidin |
| | dinotefuran |
| | imidacloprid |
| | imidaclothiz |
| | thiamethoxam |
| nitromethylene neonicotinoid insecticides | nitenpyram |
| | nithiazine |
| pyridylmethylamine neonicotinoid insecticides | acetamiprid |
| | imidacloprid |
| | nitenpyram |
| | paichongding |
| | thiacloprid |
| nereistoxin analogue insecticides | bensultap |
| | cartap |
| | polythialan |
| | thiocyclam |
| | thiosultap |
| organochlorine insecticides | bromo-DDT |
| | camphechlor |
| | DDT |
| | pp'-DDT |
| | ethyl-DDD |
| | HCH |
| | gamma-HCH |
| | lindane |
| | methoxychlor |
| | pentachlorophenol |
| | TDE |
| cyclodiene insecticides | aldrin |
| | bromocyclen |
| | chlorbicyclen |
| | chlordane |
| | chlordecone |
| | dieldrin |
| | dilor |
| | endosulfan |
| | alpha-endosulfan |
| | endrin |
| | HEOD |
| | heptachlor |
| | HHDN |
| | isobenzan |
| | isodrin |

TABLE 10-continued

Exemplary list of pesticides, which can be
combined with microbes of the disclosure

| Category | Compounds |
| --- | --- |
| | kelevan |
| | mirex |
| organophosphorus insecticides | |
| organophosphate insecticides | bromfenvinfos |
| | calvinphos |
| | chlorfenvinphos |
| | crotoxyphos |
| | dichlorvos |
| | dicrotophos |
| | dimethylvinphos |
| | fospirate |
| | heptenophos |
| | methocrotophos |
| | mevinphos |
| | monocrotophos |
| | naled |
| | naftalofos |
| | phosphamidon |
| | propaphos |
| | TEPP |
| | tetrachlorvinphos |
| organothiophosphate insecticides | dioxabenzofos |
| | fosmethilan |
| | phenthoate |
| aliphatic organothiophosphate insecticides | acethion |
| | acetophos |
| | amiton |
| | cadusafos |
| | chlorethoxyfos |
| | chlormephos |
| | demephion |
| | demephion-O |
| | demephion-S |
| | demeton |
| | demeton-O |
| | demeton-S |
| | demeton-methyl |
| | demeton-O-methyl |
| | demeton-S-methyl |
| | demeton-S-methylsulphon |
| | disulfoton |
| | ethion |
| | ethoprophos |
| | IPSP |
| | isothioate |
| | malathion |
| | methacrifos |
| | methylacetophos |
| | oxydemeton-methyl |
| | oxydeprofos |
| | oxydisulfoton |
| | phorate |
| | sulfotep |
| | terbufos |
| | thiometon |
| aliphatic amide organothiophosphate insecticides | amidithion |
| | cyanthoate |
| | dimethoate |
| | ethoate-methyl |
| | formothion |
| | mecarbam |
| | omethoate |
| | prothoate |
| | sophamide |
| | vamidothion |
| oxime organothiophosphate insecticides | chlorphoxim |
| | phoxim |
| | phoxim-methyl |
| heterocyclic organothiophosphate insecticides | azamethiphos |
| | colophonate |
| | coumaphos |
| | coumithoate |
| | dioxathion |
| | endothion |

TABLE 10-continued

Exemplary list of pesticides, which can be
combined with microbes of the disclosure

| Category | Compounds |
| --- | --- |
| | menazon |
| | morphothion |
| | phosalone |
| | pyraclofos |
| | pyrazothion |
| | pyridaphenthion |
| | quinothion |
| benzothiopyran organothiophosphate insecticides | dithicrofos |
| | thicrofos |
| benzotriazine organothiophosphate insecticides | azinphos-ethyl |
| | azinphos-methyl |
| isoindole organothiophosphate insecticides | dialifos |
| | phosmet |
| isoxazole organothiophosphate insecticides | isoxathion |
| | zolaprofos |
| pyrazolopyrimidine organothiophosphate insecticides | chlorprazophos |
| | pyrazophos |
| pyridine organothiophosphate insecticides | chlorpyrifos |
| | chlorpyrifos-methyl |
| pyrimidine organothiophosphate insecticides | butathiofos |
| | diazinon |
| | etrimfos |
| | lirimfos |
| | pirimioxyphos |
| | pirimiphos-ethyl |
| | pirimiphos-methyl |
| | primidophos |
| | pyrimitate |
| | tebupirimfos |
| quinoxaline organothiophosphate insecticides | quinalphos |
| | quinalphos-methyl |
| thiadiazole organothiophosphate insecticides | athidathion |
| | lythidathion |
| | methidathion |
| | prothidathion |
| triazole organothiophosphate insecticides | isazofos |
| | triazophos |
| phenyl organothinphosphate insecticides | azothoate |
| | bromophos |
| | bromophos-ethyl |
| | carbophenothion |
| | chlorthiophos |
| | cyanophos |
| | cythioate |
| | dicapthon |
| | dichlofenthion |
| | etaphos |
| | famphur |
| | fenchlorphos |
| | fenitrothion |
| | fensulfothion |
| | fenthion |
| | fenthion-ethyl |
| | heterophos |
| | jodfenphos |
| | mesulfenfos |
| | parathion |
| | parathion-methyl |
| | phenkapton |
| | phosnichlor |
| | profenofos |
| | prothiofos |
| | sulprofos |
| | temephos |
| | trichlormetaphos-3 |
| | trifenofos |
| | xiaochongliulin |
| phosphonate insecticides | butonate |
| | trichlorfon |
| phosphonothioate insecticides | mecarphon |
| phenyl ethylphosphonothioate insecticides | fonofos |
| | trichloronat |
| phenyl phenylphosphonothioate insecticides | cyanofenphos |
| | EPN |
| | leptophos |

TABLE 10-continued

Exemplary list of pesticides, which can be
combined with microbes of the disclosure

| Category | Compounds |
| --- | --- |
| phosphoramidate insecticides | crufomate |
| | fenamiphos |
| | fosthietan |
| | mephosfolan |
| | phosfolan |
| | phosfolan-methyl |
| | pirimetaphos |
| phosphoramidothioate insecticides | acephate |
| | chloramine phosphorus |
| | isocarbophos |
| | isofenphos |
| | isofenphos-methyl |
| | methamidophos |
| | phosglycin |
| | propetamphos |
| phosphorodiamide insecticides | dimefox |
| | mazidox |
| | mipafox |
| | schradan |
| oxadiazine insecticides | indoxacarb |
| oxadiazolone insecticides | metoxadiazone |
| phthalimide insecticides | dialifos |
| | phosmet |
| | tetramethrin |
| physical insecticides | maltodextrin |
| desiccant insecticides | boric acid |
| | diatomaceous earth |
| | silica gel |
| pyrazole insecticides | chlorantraniliprole |
| | cyantraniliprole |
| | cyclaniliprole |
| | dimetilan |
| | isolan |
| | tebufenpyrad |
| | tetraniliprole |
| | tolfenpyrad |
| phenylpyrazole insecticides | acetoprole |
| | ethiprole |
| | fipronil |
| | flufiprole |
| | pyraclofos |
| | pyrafluprole |
| | pyriprole |
| | pyrolan |
| | vaniliprole |
| pyrethroid insecticides | |
| pyrethroid ester insecticides | acrinathrin |
| | allethrin |
| | bioallethrin |
| | esdépalléthrine |
| | barthrin |
| | bifenthrin |
| | kappa-bifenthrin |
| | bioethanomethrin |
| | brofenvalerate |
| | brofluthrinate |
| | bromethrin |
| | butethrin |
| | chlorempenthrin |
| | cyclethrin |
| | cycloprothrin |
| | cyfluthrin |
| | beta-cyfluthrin |
| | cyhalothrin |
| | gamma-cyhalothrin |
| | lambda-cyhalothrin |
| | cypermethrin |
| | alpha-cypermethrin |
| | beta-cypermethrin |
| | theta-cypermethrin |
| | zeta-cypermethrin |
| | cyphenothrin |
| | deltamethrin |
| | dimefluthrin |

TABLE 10-continued

Exemplary list of pesticides, which can be
combined with microbes of the disclosure

| Category | Compounds |
| --- | --- |
| | dimethrin |
| | empenthrin |
| | d-fanshiluquebingjuzhi |
| | chloroprallethrin |
| | fenfluthrin |
| | fenpirithrin |
| | fenpropathrin |
| | fenvalerate |
| | esfenvalerate |
| | flucythrinate |
| | fluvalinate |
| | tau-fluvalinate |
| | furamethrin |
| | furethrin |
| | heptafluthrin |
| | imiprothrin |
| | japothrins |
| | kadethrin |
| | methothrin |
| | metofluthrin |
| | epsilon-metofluthrin |
| | momfluorothrin |
| | epsilon-momfluorothrin |
| | pentmethrin |
| | permethrin |
| | biopermethrin |
| | transpermethrin |
| | phenothrin |
| | prallethrin |
| | profluthrin |
| | proparthrin |
| | pyresmethrin |
| | renofluthrin |
| | meperfluthrin |
| | resmethrin |
| | bioresmethrin |
| | cismethrin |
| | tefluthrin |
| | kappa-tefluthrin |
| | terallethrin |
| | tetramethrin |
| | tetramethylfluthrin |
| | tralocythrin |
| | tralomethrin |
| | transfluthrin |
| | valerate |
| pyrethroid ether insecticides | etofenprox |
| | flufenprox |
| | halfenprox |
| | protrifenbute |
| | silafluofen |
| pyrethroid oxime insecticides | sulfoxime |
| | thiofluoximate |
| pyrimidinamine insecticides | flufenerim |
| | pyrimidifen |
| pyrrole insecticides | chlorfenapyr |
| quaternary ammonium insecticides | sanguinarine |
| sulfoximine insecticides | sulfoxaflor |
| tetramic acid insecticides | spirotetramat |
| tetronic acid insecticides | spiromesifen |
| thiazole insecticides | clothianidin |
| | imidaclothiz |
| | thiamethoxam |
| | thiapronil |
| thiazolidine insecticides | tazimcarb |
| | thiacloprid |
| thiourea insecticides | diafenthiuron |
| urea insecticides | flucofuron |
| | sulcofuron |
| zwitterionic insecticides | dicloromezotiaz |
| | triflumezopyrim |
| unclassified insecticides | afidopyropen |
| | afoxolaner |
| | allosamidin |
| | closantel |

TABLE 10-continued

Exemplary list of pesticides, which can be
combined with microbes of the disclosure

| Category | Compounds |
|---|---|
|  | copper naphthenate |
|  | crotamiton |
|  | EXD |
|  | fenazaflor |
|  | fenoxacrim |
|  | flometoquin |
|  | flonicamid |
|  | fluhexafon |
|  | flupyradifurone |
|  | fluralaner |
|  | fluxametamide |
|  | hydramethylnon |
|  | isoprothiolane |
|  | jiahuangchongzong |
|  | malonoben |
|  | metaflumizone |
|  | nifluridide |
|  | plifenate |
|  | pyridaben |
|  | pyridalyl |
|  | pyrifluquinazon |
|  | rafoxanide |
|  | thuringiensin |
|  | triarathene |
|  | triazamate |
| ACARICIDES | |
| botanical acaricides | carvacrol |
|  | sanguinarine |
| bridged diphenyl acaricides | azobenzene |
|  | benzoximate |
|  | benzyl benzoate |
|  | bromopropylate |
|  | chlorbenside |
|  | chlorfenethol |
|  | chlorfenson |
|  | chlorfensulphide |
|  | chlorobenzilate |
|  | chloropropylate |
|  | cyflumetofen |
|  | DDT |
|  | dicofol |
|  | diphenyl sulfone |
|  | dofenapyn |
|  | fenson |
|  | fentrifanil |
|  | fluorbenside |
|  | genit |
|  | hexachlorophene |
|  | phenproxide |
|  | proclonol |
|  | tetradifon |
|  | tetrasul |
| carbamate acaricides | benomyl |
|  | carbanolate |
|  | carbaryl |
|  | carbofuran |
|  | methiocarb |
|  | metolcarb |
|  | promacyl |
|  | propoxur |
| oxime carbamate acaricides | aldicarb |
|  | butocarboxim |
|  | oxamyl |
|  | thiocarboxime |
|  | thiofanox |
| carbazate acaricides | bifenazate |
| dinitrophenol acaricides | binapacryl |
|  | dinex |
|  | dinobuton |
|  | dinocap |
|  | dinocap-4 |
|  | dinocap-6 |
|  | dinocton |
|  | dinopenton |

TABLE 10-continued

Exemplary list of pesticides, which can be
combined with microbes of the disclosure

| Category | Compounds |
|---|---|
|  | dinosulfon |
|  | dinoterbon |
|  | DNOC |
| formamidine acaricides | amitraz |
|  | chlordimeform |
|  | chloromebuform |
|  | formetanate |
|  | formparanate |
|  | medimeform |
|  | semiamitraz |
| macrocyclic lactone acaricides | tetranactin |
| avermectin acaricides | abamectin |
|  | doramectin |
|  | eprinomectin |
|  | ivermectin |
|  | selamectin |
| milbemycin acaricides | milbemectin |
|  | milbemycin oxime |
|  | moxidectin |
| mite growth regulators | clofentezine |
|  | cyromazine |
|  | diflovidazin |
|  | dofenapyn |
|  | fluazuron |
|  | flubenzimine |
|  | flucycloxuron |
|  | flufenoxuron |
|  | hexythiazox |
| organochlorine acaricides | bromocyclen |
|  | camphechlor |
|  | DDT |
|  | dienochlor |
|  | endosulfan |
|  | lindane |
| organophosphorus acaricides | |
| organophosphate acaricides | chlorfenvinphos |
|  | crotoxyphos |
|  | dichlorvos |
|  | heptenophos |
|  | mevinphos |
|  | monocrotophos |
|  | naled |
|  | TEPP |
|  | tetrachlorvinphos |
| organothiophosphate acaricides | amidithion |
|  | amiton |
|  | azinphos-ethyl |
|  | azinphos-methyl |
|  | azothoate |
|  | benoxafos |
|  | bromophos |
|  | bromophos-ethyl |
|  | carbophenothion |
|  | chlorpyrifos |
|  | chlorthiophos |
|  | coumaphos |
|  | cyanthoate |
|  | demeton |
|  | demeton-O |
|  | demeton-S |
|  | demeton-methyl |
|  | demeton-O-methyl |
|  | demeton-S-methyl |
|  | demeton-S-methylsulphon |
|  | dialifos |
|  | diazinon |
|  | dimethoate |
|  | dioxathion |
|  | disulfoton |
|  | endothion |
|  | ethion |
|  | ethoate-methyl |
|  | formothion |
|  | malathion |

TABLE 10-continued

Exemplary list of pesticides, which can be
combined with microbes of the disclosure

| Category | Compounds |
| --- | --- |
| | mecarbam |
| | methacrifos |
| | omethoate |
| | oxydeprofos |
| | oxydisulfoton |
| | parathion |
| | phenkapton |
| | phorate |
| | phosalone |
| | phosmet |
| | phostin |
| | phoxim |
| | pirimiphos-methyl |
| | prothidathion |
| | prothoate |
| | pyrimitate |
| | quinalphos |
| | qumtiofos |
| | sophamide |
| | sulfotep |
| | thiometon |
| | triazophos |
| | trifenofos |
| | vamidothion |
| phosphonate acaricides | trichlorfon |
| phosphoramidothioate acaricides | isocarbophos |
| | methamidophos |
| | propetamphos |
| phosphorodiamide acaricides | dimefox |
| | mipafox |
| | schradan |
| organotin acaricides | azocyclotin |
| | cyhexatin |
| | fenbutatin oxide |
| | phostin |
| phenylsulfamide acaricides | dichlofluanid |
| phthalimide acaricides | dialifos |
| | phosmet |
| pyrazole acaricides | cyenopyrafen |
| | fenpyroximate |
| | pyflubumide |
| | tebufenpyrad |
| phenylpyrazole acaricides | acetoprole |
| | fipronil |
| | vaniliprole |
| pyrethroid acaricides | |
| pyrethroid ester acaricides | acrinathrin |
| | bifenthrin |
| | brofluthrinate |
| | cyhalothrin |
| | cypermethrin |
| | alpha-cypermethrin |
| | fenpropathrin |
| | fenvalerate |
| | flucythrinate |
| | flumethrin |
| | fluvalinate |
| | tau-fluvalinate |
| | permethrin |
| pyrethroid ether acaricides | halfenprox |
| pyrimidinamine acaricides | pyrimidifen |
| pyrrole acaricides | chlorfenapyr |
| quaternary ammonium acaricides | sanguinarine |
| quinoxaline acaricides | chinomethionat |
| | thioquinox |
| strobilurin acaricides | |
| methoxyacrylate strobilurin acaricides | bifujunzhi |
| | fluacrypyrim |
| | flufenoxystrobin |
| | pyriminostrobin |
| sulfite ester acaricides | aramite |
| | propargite |

TABLE 10-continued

Exemplary list of pesticides, which can be
combined with microbes of the disclosure

| Category | Compounds |
| --- | --- |
| tetronic acid acaricides | spirodiclofen |
| tetrazine acaricides | clofentezine |
| | diflovidazin |
| thiazolidine acaricides | flubenzimine |
| | hexythiazox |
| thiocarbamate acaricides | fenothiocarb |
| thiourea acaricides | chloromethiuron |
| | diafenthiuron |
| unclassified acaricides | acequinocyl |
| | afoxolaner |
| | amidoflumet |
| | arsenous oxide |
| | clenpirin |
| | closantel |
| | crotamiton |
| | cycloprate |
| | cymiazole |
| | disulfiram |
| | etoxazole |
| | fenazaflor |
| | fenazaquin |
| | fluenetil |
| | fluralaner |
| | mesulfen |
| | MNAF |
| | nifluridide |
| | nikkomycins |
| | pyridaben |
| | sulfiram |
| | sulfluramid |
| | sulfur |
| | thuringiensin |
| | triarathene |
| CHEMOSTERILANTS | |
| | apholate |
| | bisazir |
| | busulfan |
| | diflubenzuron |
| | dimatif |
| | hemel |
| | hempa |
| | metepa |
| | methiotepa |
| | methyl apholate |
| | morzid |
| | penfluron |
| | tepa |
| | thiohempa |
| | thiotepa |
| | tretamine |
| | uredepa |
| INSECT REPELLENTS | |
| | acrep |
| | butopyronoxyl |
| | camphor |
| | d-camphor |
| | carboxide |
| | dibutyl phthalate |
| | diethyltoluamide |
| | dimethyl carbate |
| | dimethyl phthalate |
| | dibutyl succinate |
| | ethohexadiol |
| | hexamide |
| | icaridin |
| | methoquin-butyl |
| | methylneodecanamide |
| | 2-(octylthio)ethanol |
| | oxamate |
| | quwenzhi |
| | quyingding |
| | rebemide |
| | zengxiaoan |

TABLE 10-continued

Exemplary list of pesticides, which can be
combined with microbes of the disclosure

| Category | Compounds |
| --- | --- |
| NEMATICIDES | |
| avermectin nematicides | abamectin |
| botanical nematicides | carvacrol |
| carbamate nematicides | benomyl |
| | carbofuran |
| | carbosulfan |
| | cloethocarb |
| oxime carbamate nematicides | alanycarb |
| | aldicarb |
| | aldoxycarb |
| | oxamyl |
| | tirpate |
| fumigant nematicides | carbon disulfide |
| | cyanogen |
| | 1,2-dichloropropane |
| | 1,3-dichloropropene |
| | dithioether |
| | methyl bromide |
| | methyl iodide |
| | sodium tetrathiocarbonate |
| organophosphorus nematicides | |
| organophosphate nematicides | diamidafos |
| | fenamiphos |
| | fosthietan |
| | phosphamidon |
| organothiophosphate nematicides | cadusafos |
| | chlorpyrifos |
| | dichlofenthion |
| | dimethoate |
| | ethoprophos |
| | fensulfothion |
| | fosthiazate |
| | heterophos |
| | isamidofos |
| | isazofos |
| | phorate |
| | phosphocarb |
| | terbufos |
| | thionazin |
| | triazophos |
| phosphonothioate nematicides | imicyafos |
| | mecarphon |
| unclassified nematicides | acetoprole |
| | benclothiaz |
| | chloropicrin |
| | dazomet |
| | DBCP |
| | DCIP |
| | fluazaindolizine |
| | fluensulfone |
| | furfural |
| | metam |
| | methyl isothiocyanate |
| | tioxazafen |
| | xylenols |

Insecticides also include synergists or activators that are not in themselves considered toxic or insecticidal, but are materials used with insecticides to synergize or enhance the activity of the insecticides. Syngergists or activators include piperonyl butoxide.

Biorational Pesticides

Insecticides can be biorational, or can also be known as biopesticides or biological pesticides. Biorational refers to any substance of natural origin (or man-made substances resembling those of natural origin) that has a detrimental or lethal effect on specific target pest(s), e.g., insects, weeds, plant diseases (including nematodes), and vertebrate pests, possess a unique mode of action, are non-toxic to man, domestic plants and animals, and have little or no adverse effects on wildlife and the environment.

Biorational insecticides (or biopesticides or biological pesticides) can be grouped as: (1) biochemicals (hormones, enzymes, pheromones and natural agents, such as insect and plant growth regulators), (2) microbial (viruses, bacteria, fungi, protozoa, and nematodes), or (3) Plant-Incorporated protectants (PIPs)—primarily transgenic plants, e.g., Bt corn.

Biopesticides, or biological pesticides, can broadly include agents manufactured from living microorganisms or a natural product and sold for the control of plant pests. Biopesticides can be: microorganisms, biochemicals, and semiochemicals. Biopesticides can also include peptides, proteins and nucleic acids such as double-stranded DNA, single-stranded DNA, double-stranded RNA, single-stranded RNA and hairpin DNA or RNA.

Bacteria, fungi, oomycetes, viruses and protozoa are all used for the biological control of insect pests. The most widely used microbial biopesticide is the insect pathogenic bacteria *Bacillus thuringiensis* (Bt), which produces a protein crystal (the Bt 8-endotoxin) during bacterial spore formation that is capable of causing lysis of gut cells when consumed by susceptible insects. Microbial Bt biopesticides consist of bacterial spores and 8-endotoxin crystals mass-produced in fermentation tanks and formulated as a sprayable product. Bt does not harm vertebrates and is safe to people, beneficial organisms and the environment. Thus, Bt sprays are a growing tactic for pest management on fruit and vegetable crops where their high level of selectivity and safety are considered desirable, and where resistance to synthetic chemical insecticides is a problem. Bt sprays have also been used on commodity crops such as maize, soybean and cotton, but with the advent of genetic modification of plants, farmers are increasingly growing Bt transgenic crop varieties.

Other microbial insecticides include products based on entomopathogenic baculoviruses. Baculoviruses that are pathogenic to arthropods belong to the virus family and possess large circular, covalently closed, and double-stranded DNA genomes that are packaged into nucleocapsids. More than 700 baculoviruses have been identified from insects of the orders Lepidoptera, Hymenoptera, and Diptera. Baculoviruses are usually highly specific to their host insects and thus, are safe to the environment, humans, other plants, and beneficial organisms. Over 50 baculovirus products have been used to control different insect pests worldwide. In the US and Europe, the *Cydia pomonella* granulovirus (CpGV) is used as an inundative biopesticide against codling moth on apples. Washington State, as the biggest apple producer in the US, uses CpGV on 13% of the apple crop. In Brazil, the nucleopolyhedrovirus of the soy bean caterpillar *Anticarsia gemmatalis* was used on up to 4 million ha (approximately 35%) of the soybean crop in the mid-1990s. Viruses such as Gemstar® (Certis USA) are available to control larvae of *Heliothis* and *Helicoverpa* species.

At least 170 different biopesticide products based on entomopathogenic fungi have been developed for use against at least five insect and acarine orders in glasshouse crops, fruit and field vegetables as well as commodity crops. The majority of products are based on the ascomycetes *Beauveria bassiana* or *Metarhizium anisopliae*. *M. anisopliae* has also been developed for the control of locust and grasshopper pests in Africa and Australia and is recommended by the Food and Agriculture Organization of the United Nations (FAO) for locust management.

A number of microbial pesticides registered in the United States are listed in Table 16 of Kabaluk et al. 2010 (Kabaluk, J. T. et al. (ed.). 2010. The Use and Regulation of Microbial Pesticides in Representative Jurisdictions Worldwide. IOBC Global. 99 pp.) and microbial pesticides registered in selected countries are listed in Annex 4 of Hoeschle-Zeledon et al. 2013 (Hoeschle-Zeledon, I., P. Neuenschwander and L. Kumar. (2013). Regulatory Challenges for biological control. SP-IPM Secretariat, International Institute of Tropical Agriculture (IITA), Ibadan, Nigeria. 43 pp.), each of which is incorporated herein in its entirety.

Plants produce a wide variety of secondary metabolites that deter herbivores from feeding on them. Some of these can be used as biopesticides. They include, for example, pyrethrins, which are fast-acting insecticidal compounds produced by *Chrysanthemum cinerariaefolium*. They have low mammalian toxicity but degrade rapidly after application. This short persistence prompted the development of synthetic pyrethrins (pyrethroids). The most widely used botanical compound is neem oil, an insecticidal chemical extracted from seeds of *Azadirachta indica*. Two highly active pesticides are available based on secondary metabolites synthesized by soil actinomycetes, but they have been evaluated by regulatory authorities as if they were synthetic chemical pesticides. Spinosad is a mixture of two macrolide compounds from *Saccharopolyspora spinosa*. It has a very low mammalian toxicity and residues degrade rapidly in the field. Farmers and growers used it widely following its introduction in 1997 but resistance has already developed in some important pests such as western flower thrips. Abamectin is a macrocyclic lactone compound produced by *Streptomyces avermitilis*. It is active against a range of pest species but resistance has developed to it also, for example, in tetranychid mites.

Peptides and proteins from a number of organisms have been found to possess pesticidal properties. Perhaps most prominent are peptides from spider venom (King, G. F. and Hardy, M. C. (2013) Spider-venom peptides: structure, pharmacology, and potential for control of insect pests. Annu. Rev. Entomol. 58:475-496). A unique arrangement of disulfide bonds in spider venom peptides render them extremely resistant to proteases. As a result, these peptides are highly stable in the insect gut and hemolymph and many of them are orally active. The peptides target a wide range of receptors and ion channels in the insect nervous system. Other examples of insecticidal peptides include: sea anemone venom that act on voltage-gated Na+ channels (Bosmans, F. and Tytgat, J. (2007) Sea anemone venom as a source of insecticidal peptides acting on voltage-gated Na+ channels. Toxicon. 49 (4): 550-560); the PAlb (Pea Albumin 1, subunit b) peptide from Legume seeds with lethal activity on several insect pests, such as mosquitoes, some aphids and cereal weevils (Eyraud, V. et al. (2013) Expression and Biological Activity of the Cystine Knot Bioinsecticide PAlb (Pea Albumin 1 Subunit b). PLOS ONE 8 (12): e81619); and an internal 10 kDa peptide generated by enzymatic hydrolysis of *Canavalia ensiformis* (jack bean) urease within susceptible insects (Martinelli, A. H. S., et al. (2014) Structure-function studies on jaburetox, a recombinant insecticidal peptide derived from jack bean (*Canavalia ensiformis*) urease. Biochimica et Biophysica Acta 1840:935-944). Examples of commercially available peptide insecticides include Spear™-T for the treatment of *thrips* in vegetables and ornamentals in greenhouses, Spear™-P to control the Colorado Potato Beetle, and Spear™-C to protect crops from lepidopteran pests (Vestaron Corporation, Kalamazoo, MI). A novel insecticidal protein from *Bacillus* bombysepticus, called parasporal crystal toxin (PC), shows oral pathogenic activity and lethality towards silkworms and Cry1Ac-resistant *Helicoverpa armigera* strains (Lin, P. et al. (2015) PC, a novel oral insecticidal toxin from *Bacillus* bombysepticus involved in host lethality via APN and BtR-175. Sci. Rep. 5:11101).

A semiochemical is a chemical signal produced by one organism that causes a behavioral change in an individual of the same or a different species. The most widely used semiochemicals for crop protection are insect sex pheromones, some of which can now be synthesized and are used for monitoring or pest control by mass trapping, lure-and-kill systems and mating disruption. Worldwide, mating disruption is used on over 660,000 ha and has been particularly useful in orchard crops.

As used herein, "transgenic insecticidal trait" refers to a trait exhibited by a plant that has been genetically engineered to express a nucleic acid or polypeptide that is detrimental to one or more pests. In one embodiment, the plants of the present disclosure are resistant to attach and/or infestation from any one or more of the pests of the present disclosure. In one embodiment, the trait comprises the expression of vegetative insecticidal proteins (VIPs) from *Bacillus thuringiensis*, lectins and proteinase inhibitors from plants, terpenoids, cholesterol oxidases from *Streptomyces* spp., insect chitinases and fungal chitinolytic enzymes, bacterial insecticidal proteins and early recognition resistance genes. In another embodiment, the trait comprises the expression of a *Bacillus thuringiensis* protein that is toxic to a pest. In one embodiment, the Bt protein is a Cry protein (crystal protein). Bt crops include Bt corn, Bt cotton and Bt soy. Bt toxins can be from the Cry family (see, for example, Crickmore et al., 1998, Microbiol. Mol. Biol. Rev. 62:807-812), which are particularly effective against Lepidoptera, Coleoptera and Diptera.

Bt Cry and Cyt toxins belong to a class of bacterial toxins known as pore-forming toxins (PFT) that are secreted as water-soluble proteins undergoing conformational changes in order to insert into, or to translocate across, cell membranes of their host. There are two main groups of PFT: (i) the α-helical toxins, in which α-helix regions form the trans-membrane pore, and (ii) the β-barrel toxins, that insert into the membrane by forming a β-barrel composed of βsheet hairpins from each monomer. See, Parker M W, Feil S C, "Pore-forming protein toxins: from structure to function," Prog. Biophys. Mol. Biol. 2005 May; 88 (1): 91-142. The first class of PFT includes toxins such as the colicins, exotoxin A, diphtheria toxin and also the Cry three-domain toxins. On the other hand, aerolysin, α-hemolysin, anthrax protective antigen, cholesterol-dependent toxins as the perfringolysin O and the Cyt toxins belong to the β-barrel toxins. Id. In general, PFT producing-bacteria secrete their toxins and these toxins interact with specific receptors located on the host cell surface. In most cases, PFT are activated by host proteases after receptor binding inducing the formation of an oligomeric structure that is insertion competent. Finally, membrane insertion is triggered, in most cases, by a decrease in pH that induces a molten globule state of the protein. Id.

The development of transgenic crops that produce Bt Cry proteins has allowed the substitution of chemical insecticides by environmentally friendly alternatives. In transgenic plants the Cry toxin is produced continuously, protecting the toxin from degradation and making it reachable to chewing and boring insects. Cry protein production in plants has been improved by engineering cry genes with a plant biased codon usage, by removal of putative splicing signal sequences and deletion of the carboxy-terminal region of the protoxin. See, Schuler T H, et al., "Insect-resistant transgenic plants," Trends Biotechnol. 1998; 16:168-175. The use of insect resistant crops has diminished considerably the use of chemical pesticides in areas where these transgenic crops are planted. See, Qaim M, Zilberman D, "Yield effects of genetically modified crops in developing countries," Science. 2003 Feb. 7; 299 (5608): 900-2.

Known Cry proteins include: δ-endotoxins including but not limited to: the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry 51, Cry52, Cry 53, Cry 54, Cry55, Cry56, Cry57, Cry58, Cry59. Cry60, Cry61, Cry62, Cry63, Cry64, Cry65, Cry66, Cry67, Cry68, Cry69, Cry70 and Cry71 classes of δ-endotoxin genes and the *B. thuringiensis* cytolytic cyt1 and cyt2 genes.

Members of these classes of *B. thuringiensis* insecticidal proteins include, but are not limited to: Cry1Aa1 (Accession #AAA22353); Cry1Aa2 (Accession #Accession #AAA22552); Cry1Aa3 (Accession #BAA00257); Cry1Aa4 (Accession #CAA31886); Cry1Aa5 (Accession #BAA04468); Cry1Aa6 (Accession #AAA86265); Cry1Aa7 (Accession #AAD46139); Cry1Aa8 (Accession #126149); Cry1Aa9 (Accession #BAA77213); Cry1Aa10 (Accession #AAD55382); Cry1Aa11 (Accession #CAA70856); Cry1Aa12 (Accession #AAP80146); Cry1Aa13 (Accession #AAM44305); Cry1Aa14 (Accession #AAP40639); Cry1Aa15 (Accession #AAY66993); Cry1Aa16 (Accession #HQ439776); Cry1Aa17 (Accession #HQ439788); Cry1Aa18 (Accession #HQ439790); Cry1Aa19 (Accession #HQ685121); Cry1Aa20 (Accession #JF340156); Cry1Aa211 (Accession #JN651496); Cry1Aa221 (Accession #KC158223); Cry1Ab1 (Accession #AAA22330); Cry1Ab2 (Accession #AAA22613); Cry1Ab3 (Accession #AAA22561); Cry1Ab4 (Accession #BAA00071); Cry1Ab5 (Accession #CAA28405); Cry1Ab6 (Accession #AAA22420); Cry1Ab7 (Accession #CAA31620); Cry1Ab81 (Accession #AAA22551); Cry1Ab9 (Accession #CAA38701); Cry1Ab10 (Accession #A29125); Cry1Ab11 (Accession #112419); Cry1Ab12 (Accession #AAC64003); Cry1Ab13 (Accession #AAN76494); Cry1Ab14 (Accession #AAG16877); Cry1Ab15 (Accession #AAO13302); Cry1Ab161 (Accession #AAK55546); Cry1Ab17 (Accession #AAT46415); Cry1Ab18 (Accession #AAQ88259); Cry1Ab19 (Accession #AAW31761); Cry1Ab20 (Accession #ABB72460); Cry1Ab21 (Accession #ABS18384); Cry1Ab22 (Accession #ABW87320); Cry1Ab23 (Accession #HQ439777); Cry1Ab24 (Accession #HQ439778); Cry1Ab25 (Accession #HQ685122); Cry1Ab26 (Accession #HQ847729); Cry1Ab27 (Accession #JN135249); Cry1Ab28 (Accession #JN135250); Cry1Ab29 (Accession #JN135251); Cry1Ab30 (Accession #JN135252); Cry1Ab31 (Accession #JN135253); Cry1Ab32 (Accession #JN135254); Cry1Ab33 (Accession #AAS93798); Cry1Ab34 (Accession #KC156668); Cry1Ab-like (Accession #AAK14336); Cry1Ab-like (Accession #AAK14337); Cry1Ab-like (Accession #AAK14338); Cry1Ab-like (Accession #ABG88858); Cry1Ac1 (Accession #AAA22331); Cry1Ac2 (Accession #AAA22338); Cry1Ac3 (Accession #CAA38098); Cry1Ac4 (Accession #AAA73077); Cry1Ac5 (Accession #AAA22339); Cry1Ac6 (Accession #AAA86266); Cry1Ac7 (Accession #AAB46989);

Cry1Ac8 (Accession #AAC44841); Cry1Ac9 (Accession #AAB49768); Cry1Ac10 (Accession #CAA05505); Cry1Ac11 (Accession #CAA10270); Cry1Ac12 (Accession #112418); Cry1Ac13 (Accession #AAD38701); Cry1Ac14 (Accession #AAQ06607); Cry1Ac15 (Accession #AAN07788); Cry1Ac16 (Accession #AAU87037); Cry1Ac17 (Accession #AAX18704); Cry1Ac18 (Accession #AAY88347); Cry1Ac19 (Accession #ABD37053); Cry1Ac20 (Accession #ABB89046); Cry1Ac21 (Accession #AAY66992); Cry1Ac22 (Accession #ABZ01836); Cry1Ac23 (Accession #CAQ30431); Cry1Ac24 (Accession #ABL01535); Cry1Ac25 (Accession #FJ513324); Cry1Ac26 (Accession #FJ617446); Cry1Ac27 (Accession #FJ617447); Cry1Ac28 (Accession #ACM90319); Cry1Ac29 (Accession #DQ438941); Cry1Ac30 (Accession #GQ227507); Cry1Ac31 (Accession #GU446674); Cry1Ac321 (Accession #HM061081); Cry1Ac331 (Accession #GQ866913); Cry1Ac34 (Accession #HQ230364); Cry1Ac35 (Accession #JF340157); Cry1Ac361 (Accession #JN387137); Cry1Ac37 (Accession #JQ317685); Cry1Ad1 (Accession #AAA22340); Cry1Ad2 (Accession #CAA01880); Cry1Ae1 (Accession #AAA22410); Cry1Af1 (Accession #AAB82749); Cry1Ag1 (Accession #AAD46137); Cry1Ah1 (Accession #AAQ14326); Cry1Ah2 (Accession #ABB76664); Cry1Ah3 (Accession #HQ439779); Cry1Ai1 (Accession #AAO39719); Cry1Ai2 (Accession #HQ439780); Cry1A-like (Accession #AAK14339); Cry1Ba1 (Accession #CAA29898); Cry1Ba21 (Accession #CAA65003); Cry1Ba3 (Accession #AAK63251); Cry1Ba4 (Accession #AAK51084); Cry1Ba5 (Accession #AB020894); Cry1Ba6 (Accession #ABL60921); Cry1Ba7 (Accession #HQ439781); Cry1Bb1 (Accession #AAA22344); Cry1Bb2 (Accession #HQ439782); Cry1Bc1 (Accession #CAA86568); Cry1Bd1 (Accession #AAD10292); Cry1Bd2 (Accession #AAM93496); Cry1Be1 (Accession #AAC32850); Cry1Be2 (Accession #AAQ52387); Cry1Be3 (Accession #ACV96720); Cry1Be4 (Accession #HM070026); Cry1Bf1 (Accession #CAC50778); Cry1Bf2 (Accession #AAQ52380); Cry1Bg1 (Accession #AAO39720); Cry1Bh1 (Accession #HQ589331); Cry1Bi1 (Accession #KC156700); Cry1Ca1 (Accession #CAA30396); Cry1Ca2 (Accession #CAA31951); Cry1Ca3 (Accession #AAA22343); Cry1Ca4 (Accession #CAA01886); Cry1Ca5 (Accession #CAA65457); Cry1Ca6 [1] (Accession #AAF37224); Cry1Ca7 (Accession #AAG50438); Cry1Ca8 (Accession #AAM00264); Cry1Ca91 (Accession #AAL79362); Cry1Ca10 (Accession #AAN16462); Cry1Ca11 (Accession #AAX53094); Cry1Ca12 (Accession #HM070027); Cry1Ca13 (Accession #HQ412621); Cry1Ca14 (Accession #JN651493); Cry1Cb1 (Accession #M97880); Cry1Cb2 (Accession #AAG35409); Cry1Cb3 (Accession #ACD50894); Cry1Cb-like (Accession #AAX63901); Cry1Da1 (Accession #CAA38099); Cry1Da2 (Accession #176415); Cry1Da3 (Accession #HQ439784); Cry1 Db1 (Accession #CAA80234); Cry1 Db2 (Accession #AAK48937); Cry1 Dc1 (Accession #ABK35074); Cry1Ea1 (Accession #CAA37933); Cry1Ea2 (Accession #CAA39609); Cry1Ea3 (Accession #AAA22345); Cry1Ea4 (Accession #AAD04732); Cry1Ea5 (Accession #A15535); Cry1Ea6 (Accession #AAL50330); Cry1Ea7 (Accession #AAW72936); Cry1Ea8 (Accession #ABX11258); Cry1Ea9 (Accession #HQ439785); Cry1Ea10 (Accession #ADR00398); Cry1Ea11 (Accession #JQ652456); Cry1Eb1 (Accession #AAA22346); Cry1Fa1 (Accession #AAA22348); Cry1Fa2 (Accession #AAA22347); Cry1Fa3 (Accession #HM070028); Cry1Fa4

(Accession #HM439638); Cry1 Fb1 (Accession #CAA80235); Cry1Fb2 (Accession #BAA25298); Cry1Fb3 (Accession #AAF21767); Cry1Fb4 (Accession #AAC10641); Cry1Fb5 (Accession #AA013295); Cry1Fb6 (Accession #ACD50892); Cry1Fb7 (Accession #ACD50893); Cry1Ga1 (Accession #CAA80233); Cry1Ga2 (Accession #CAA70506); Cry1Gb1 (Accession #AAD10291); Cry1Gb2 (Accession #AA013756); Cry1Gc1 (Accession #AAQ52381); Cry1Ha1 (Accession #CAA80236); Cry1Hb1 (Accession #AAA79694); Cry1Hb21 (Accession #HQ439786); Cry1H-like (Accession #AAF01213); Cry1Ia1 (Accession #CAA44633); Cry1Ia2 (Accession #AAA22354); Cry1Ia3 (Accession #AAC36999); Cry1Ia4 (Accession #AAB00958); Cry1Ia5 (Accession #CAA70124); Cry1Ia6 (Accession #AAC26910); Cry1Ia7 (Accession #AAM73516); Cry1Ia8 (Accession #AAK66742); Cry1Ia9 (Accession #AAQ08616); Cry1Ia10 (Accession #AAP86782); Cry1Ia11 (Accession #CAC85964); Cry1Ia12 (Accession #AAV53390); Cry1Ia13 (Accession #ABF83202); Cry1Ia14 (Accession #ACG63871); Cry1Ia15 (Accession #FJ617445); Cry1Ia16 (Accession #FJ617448); Cry1Ia17 (Accession #GU989199); Cry1Ia18 (Accession #ADK23801); Cry1Ia19 (Accession #HQ439787); Cry1Ia20 (Accession #JQ228426); Cry1Ia21 (Accession #JQ228424); Cry1Ia22 (Accession #JQ228427); Cry1Ia23 (Accession #JQ228428); Cry1Ia24 (Accession #JQ228429); Cry1Ia25 (Accession #JQ228430); Cry1Ia26 (Accession #JQ228431); Cry1Ia27 (Accession #JQ228432); Cry1Ia28 (Accession #JQ228433); Cry1Ia29 (Accession #JQ228434); Cry1Ia30 (Accession #JQ317686); Cry1Ia31 (Accession #JX944038); Cry1Ia32 (Accession #JX944039); Cry1Ia33 (Accession #JX944040); Cry1Ib1 (Accession #AAA82114); Cry1Ib2 (Accession #ABW88019); Cry1Ib3 (Accession #ACD75515); Cry1Ib4 (Accession #HM051227); Cry1Ib5 (Accession #HM070028); Cry1Ib6 (Accession #ADK38579); Cry1Ib7 (Accession #JN571740); Cry1Ib8 (Accession #JN675714); Cry1Ib9 (Accession #JN675715); Cry1Ib10 (Accession #JN675716); Cry1Ib11 (Accession #JQ228423); Cry1Ic1 (Accession #AAC62933); Cry1Ic2 (Accession #AAE71691); Cry1Id1 (Accession #AAD44366); Cry1Id2 (Accession #JQ228422); Cry1Ie1 (Accession #AAG43526); Cry1Ie2 (Accession #HM439636); Cry1Ie3 (Accession #KC156647); Cry1Ie4 (Accession #KC156681); Cry1If1 (Accession #AAQ52382); Cry1Ig1 (Accession #KC156701); Cry1I-like (Accession #AAC31094); Cry1I-like (Accession #ABG88859); Cry1Ja1 (Accession #AAA22341); Cry1Ja2 (Accession #HM070030); Cry1Ja3 (Accession #JQ228425); Cry1Jb1 (Accession #AAA98959); Cry1Jc1 (Accession #AAC31092); Cry1Jc2 (Accession #AAQ52372); Cry1Jd1 (Accession #CAC50779); Cry1Ka1 (Accession #AAB00376); Cry1Ka2 (Accession #HQ439783); Cry1La1 (Accession #AAS60191); Cry1La2 (Accession #HM070031); Cry1Ma1 (Accession #FJ884067); Cry1Ma2 (Accession #KC156659); Cry1Na1 (Accession #KC156648); Cry1Nb1 (Accession #KC156678); Cry1-like (Accession #AAC31091); Cry2Aa1 (Accession #AAA22335); Cry2Aa2 (Accession #AAA83516); Cry2Aa3 (Accession #D86064); Cry2Aa4 (Accession #AAC04867); Cry2Aa5 (Accession #CAA10671); Cry2Aa6 (Accession #CAA10672); Cry2Aa7 (Accession #CAA10670); Cry2Aa8 (Accession #AA013734); Cry2Aa9 (Accession #AA013750); Cry2Aa1 O (Accession #AAQ04263); Cry2Aa11 (Accession #AAQ52384); Cry2Aa12 (Accession #AB183671); Cry2Aa13 (Accession #ABL01536); Cry2Aa14 (Accession #ACF04939);

Cry2Aa15 (Accession #JN426947); Cry2Ab1 (Accession #AAA22342); Cry2Ab2 (Accession #CAA39075); Cry2Ab31 (Accession #AAG36762); Cry2Ab41 (Accession #AA013296); Cry2Ab51 (Accession #AAQ04609); Cry2Ab61 (Accession #AAP59457); Cry2Ab71 (Accession #AAZ66347); Cry2Ab81 (Accession #ABC95996); Cry2Ab91 (Accession #ABC74968); Cry2Ab101 (Accession #EF157306); Cry2Ab11 (Accession #CAM84575); Cry2Ab12 (Accession #ABM21764); Cry2Ab13 (Accession #ACG76120); Cry2Ab14 (Accession #ACG76121); Cry2Ab15 (Accession #HM037126); Cry2Ab16 (Accession #GQ866914); Cry2Ab17 (Accession #HQ439789); Cry2Ab18 (Accession #JN135255); Cry2Ab19 (Accession #JN135256); Cry2Ab20 (Accession #JN135257); Cry2Ab21 (Accession #JN135258); Cry2Ab22 (Accession #JN135259); Cry2Ab23 (Accession #JN135260); Cry2Ab24 (Accession #JN135261); Cry2Ab25 (Accession #JN415485); Cry2Ab26 (Accession #JN426946); Cry2Ab27 (Accession #JN415764); Cry2Ab28 (Accession #JN651494); Cry2Ac1 (Accession #CAA40536); Cry2Ac2 (Accession #AAG35410); Cry2Ac3 (Accession #AAQ52385); Cry2Ac4 (Accession #ABC95997); Cry2Ac5 (Accession #ABC74969); Cry2Ac6 (Accession #ABC74793); Cry2Ac7 (Accession #CAL18690); Cry2Ac8 (Accession #CAM09325); Cry2Ac9 (Accession #CAM09326); Cry2Ac10 (Accession #ABN15104); Cry2Ac11 (Accession #CAM83895); Cry2Ac12 (Accession #CAM83896); Cry2Ad1 (Accession #AAF09583); Cry2Ad2 (Accession #ABC86927); Cry2Ad3 (Accession #CAK29504); Cry2Ad4 (Accession #CAM32331); Cry2Ad5 (Accession #CA078739); Cry2Ae1 (Accession #AAQ52362); Cry2Af1 (Accession #AB030519); Cry2Af2 (Accession #GQ866915); Cry2Ag1 (Accession #ACH91610); Cry2Ah1 (Accession #EU939453); Cry2Ah2 (Accession #ACL80665); Cry2Ah3 (Accession #GU073380); Cry2Ah4 (Accession #KC156702); Cry2Ai1 (Accession #FJ788388); Cry2Aj (Accession #); Cry2Ak1 (Accession #KC156660); Cry2Ba1 (Accession #KC156658); Cry3Aa1 (Accession #AAA22336); Cry3Aa2 (Accession #AAA22541); Cry3Aa3 (Accession #CAA68482); Cry3Aa4 (Accession #AAA22542); Cry3Aa5 (Accession #AAA50255); Cry3Aa6 (Accession #AAC43266); Cry3 Aa7 (Accession #CAB41411); Cry3Aa8 (Accession #AAS79487); Cry3Aa9 (Accession #AAW05659); Cry3Aa10 (Accession #AAU29411); Cry3Aa11 (Accession #AAW82872); Cry3Aa12 (Accession #ABY49136); Cry3Ba1 (Accession #CAA34983); Cry3Ba2 (Accession #CAA00645); Cry3Ba3 (Accession #JQ397327); Cry3Bb1 (Accession #AAA22334); Cry3Bb2 (Accession #AAA74198); Cry3Bb3 (Accession #115475); Cry3Ca1 (Accession #CAA42469); Cry4Aa1 (Accession #CAA68485); Cry4Aa2 (Accession #BAAOOI 79); Cry4Aa3 (Accession #CAD30148); Cry4Aa4 (Accession #AFB18317); Cry4A-like (Accession #AAY96321); Cry4Ba1 (Accession #CAA30312); Cry4Ba2 (Accession #CAA30114); Cry4Ba3 (Accession #AAA22337); Cry4Ba4 (Accession #BAAOOI 78); Cry4Ba5 (Accession #CAD30095); Cry4Ba-like (Accession #ABC47686); Cry4Ca1 (Accession #EU646202); Cry4Cb1 (Accession #FJ403208); Cry4Cb21 (Accession #FJ597622); Cry4Cc1 (Accession #FJ403207); Cry5Aa1 (Accession #AAA67694); Cry5Ab1 (Accession #AAA67693); Cry5Ac1 (Accession #134543); Cry5Ad1 (Accession #ABQ82087); Cry5Ba1 (Accession #AAA68598); Cry5Ba2 (Accession #ABW88931); Cry5Ba3 (Accession #AFJ04417); Cry5Ca1 (Accession #HM461869); Cry5Ca2 (Accession #ZP_04123426); Cry5Da1 (Accession

HM461870); Cry5Da21 (Accession #ZP__04123980); Cry5Ea1 (Accession #HM485580); Cry5Ea21 (Accession #ZP_04124038); Cry6Aa1 (Accession #AAA22357); Cry6Aa2 (Accession #AAM46849); Cry6Aa3 (Accession #ABH03377); Cry6Ba1 (Accession #AAA22358); Cry7 Aa1 (Accession #AAA22351); Cry7Ab1 (Accession #AAA21120); Cry7Ab2 (Accession #AAA21121); Cry7Ab3 (Accession #ABX24522); Cry7 Ab4 (Accession #EU380678); Cry7 Ab5 (Accession #ABX79555); Cry7 Ab6 (Accession #ACI44005); Cry7 Ab7 (Accession #ADB89216); Cry7 Ab8 (Accession #GU145299); Cry7Ab9 (Accession #ADD92572); Cry7Ba1 (Accession #ABB70817); Cry7Bb1 (Accession #KC156653); Cry7Ca1 (Accession #ABR67863); Cry7Cb1 (Accession #KC156698); Cry7Da1 (Accession #ACQ99547); Cry7Da2 (Accession #HM572236); Cry7Da3 (Accession #KC156679); Cry7Ea1 (Accession #HM035086); Cry7Ea2 (Accession #HM132124); Cry7Ea3 (Accession #EEM19403); Cry7Fa1 (Accession #HM035088); Cry7Fa2 (Accession #EEM19090); Cry7Fb1 (Accession #HM572235); Cry7Fb2 (Accession #KC156682); Cry7Ga1 (Accession #HM572237); Cry7Ga2 (Accession #KC156669); Cry7Gb1 (Accession #KC156650); Cry7Gc1 (Accession #KC156654); Cry7Gd1 (Accession #KC156697); Cry7Ha1 (Accession #KC156651); Cry7Ia1 (Accession #KC156665); Cry7Ja1 (Accession #KC156671); Cry7Ka1 (Accession #KC156680); Cry7Kb1 (Accession #BAM99306); Cry7La1 (Accession #BAM99307); Cry8Aa1 (Accession #AAA21117); Cry8Ab1 (Accession #EU044830); Cry8Ac1 (Accession #KC156662); Cry8Ad1 (Accession #KC156684); Cry8Ba1 (Accession #AAA21118); Cry8Bb1 (Accession #CAD57542); Cry8Bc1 (Accession #CAD57543); Cry8Ca1 (Accession #AAA21119); Cry8Ca2 (Accession #AAR98783); Cry8Ca3 (Accession #EU625349); Cry8Ca4 (Accession #ADB54826); Cry8Da1 (Accession #BAC07226); Cry8Da2 (Accession #BD133574); Cry8Da3 (Accession #BD133575); Cry8Db1 (Accession #BAF93483); Cry8Ea1 (Accession #AAQ73470); Cry8Ea2 (Accession #EU047597); Cry8Ea31 (Accession #KC855216); Cry8Fa1 (Accession #AAT48690); Cry8Fa2 (Accession #HQ1 74208); Cry8Fa3 (Accession #AFH78109); Cry8Ga1 (Accession #AAT46073); Cry8Ga21 (Accession #ABC42043); Cry8Ga31 (Accession #FJ198072); Cry8Ha1 (Accession #AAW81032); Cry8Ia1 (Accession #EU381044); Cry8Ia2 (Accession #GU073381); Cry8Ia3 (Accession #HM044664); Cry8Ia4 (Accession #KC156674); Cry8Ib1 (Accession #GU325772); Cry8Ib2 (Accession #KC156677); Cry8Ja11 (Accession #EU625348); Cry8Ka1 (Accession #FJ422558); Cry8Ka21 (Accession #ACN87262); Cry8Kb1 (Accession #HM123758); Cry8Kb21 (Accession #KC156675); Cry8La1 (Accession #GU325771); Cry8Ma1 (Accession #HM044665); Cry8Ma2 (Accession #EEM86551); Cry8Ma3 (Accession #HM210574); Cry8Na1 (Accession #HM640939); Cry8Pa1 (Accession #HQ388415); Cry8Qa1 (Accession #HQ441166); Cry8Qa21 (Accession #KC152468); Cry8Ra1 (Accession #AFP87548); Cry8Sa1 (Accession #JQ740599); Cry8Ta1 (Accession #KC156673); Cry8-like (Accession #FJ770571); Cry8-like (Accession #ABS53003); Cry9Aa1 (Accession #CAA41122); Cry9Aa2 (Accession #CAA41425); Cry9Aa3 (Accession #GQ249293); Cry9Aa4 (Accession #GQ249294); Cry9Aa5 (Accession #JX1 74110); Cry9Aa like (Accession #AAQ52376); Cry9Ba1 (Accession #CAA52927); Cry9Ba2 (Accession #GU299522); Cry9Bb1 (Accession #AAV28716); Cry9Ca1 (Accession #CAA85764); Cry9Ca2

(Accession #AAQ52375); Cry9Da1 (Accession #BAAI 9948); Cry9Da2 (Accession #AAB97923); Cry9Da3 (Accession #GQ249293); Cry9Da4 (Accession #GQ249297); Cry9Db1 (Accession #AAX78439); Cry9Dc1 (Accession #KCl 56683); Cry9Ea1 (Accession #BAA34908); Cry9Ea2 (Accession #AA012908); Cry9Ea3 (Accession #ABM21765); Cry9Ea41 (Accession #ACE88267); Cry9Ea5 (Accession #ACF04743); Cry9Ea6 (Accession #ACG63872); Cry9Ea7 (Accession #FJ380927); Cry9Ea8 (Accession #GQ249292); Cry9Ea91 (Accession #JN651495); Cry9Eb1 (Accession #CAC50780); Cry9Eb21 (Accession #GQ249298); Cry9Eb3 (Accession #KC156646); Cry9Ec1 (Accession #AAC63366); Cry9Ed1 (Accession #AAX78440); Cry9Ee1 (Accession #GQ249296); Cry9Ee2 (Accession #KC156664); Cry9Fa1 (Accession #KC156692); Cry9Ga1 (Accession #KC156699); Cry9-like (Accession #AAC63366); Cry10Aa1 (Accession #AAA22614); Cry10Aa2 (Accession #E00614); Cry10Aa3 (Accession #CAD30098); Cry10Aa4 (Accession #AFB18318); Cry10A-like (Accession #DQ167578); Cry11Aa1 (Accession #AAA22352); Cry11Aa2 (Accession #AAA22611); Cry11Aa3 (Accession #CAD30081); Cry11Aa4 (Accession #AFB18319); Cry11Aa-like (Accession #DQ166531); Cry11Ba1 (Accession #CAA60504); Cry11Bb1 (Accession #AAC97162); Cry11Bb2 (Accession #HM068615); Cry12Aa1 (Accession #AAA22355); Cry13Aa1 (Accession #AAA22356); Cry14Aa1 (Accession #AAA21516); Cry14Ab1 (Accession #KC156652); Cry15Aa1 (Accession #AAA22333); Cry16Aa1 (Accession #CAA63860); Cry17Aa1 (Accession #CAA67841); Cry18Aa1 (Accession #CAA67506); Cry18Ba1 (Accession #AAF89667); Cry18Ca1 (Accession #AAF89668); Cry19Aa1 (Accession #CAA68875); Cry19Ba1 (Accession #BAA32397); Cry19Ca1 (Accession #AFM37572); Cry20Aa1 (Accession #AAB93476); Cry20Ba1 (Accession #ACS93601); Cry20Ba2 (Accession #KC156694); Cry20-like (Accession #GQ144333); Cry21Aa1 (Accession #132932); Cry21Aa2 (Accession #166477); Cry21Ba1 (Accession #BAC06484); Cry21Ca1 (Accession #JF521577); Cry21Ca21 (Accession #KC156687); Cry21Da1 (Accession #JF521578); Cry22Aa1 (Accession #134547); Cry22Aa2 (Accession #CAD43579); Cry22Aa3 (Accession #ACD93211); Cry22Ab1 (Accession #AAK50456); Cry22Ab2 (Accession #CAD43577); Cry22Ba1 (Accession #CAD43578); Cry22Bb1 (Accession #KC156672); Cry23Aa1 (Accession #AAF76375); Cry24Aa1 (Accession #AAC61891); Cry24Ba1 (Accession #BAD32657); Cry24Ca1 (Accession #CAJ43600); Cry25Aa1 (Accession #AAC61892); Cry26Aa1 (Accession #AAD25075); Cry27Aa1 (Accession #BAA82796); Cry28Aa1 (Accession #AAD24189); Cry28Aa2 (Accession #AAG00235); Cry29Aa1 (Accession #CAC80985); Cry30Aa1 (Accession #CAC80986); Cry30Ba1 (Accession #BAD00052); Cry30Ca1 (Accession #BAD67157); Cry30Ca21 (Accession #ACU24781); Cry30Da1 (Accession #EF095955); Cry30Db1 (Accession #BAE80088); Cry30Ea1 (Accession #ACC95445); Cry30Ea2 (Accession #FJ499389); Cry30Fa1 (Accession #ACI22625); Cry30Ga1 (Accession #ACG60020); Cry30Ga2 (Accession #HQ638217); Cry31Aa1 (Accession #BABII 757); Cry31Aa2 (Accession #AAL87458); Cry31Aa3 (Accession #BAE79808); Cry31Aa4 (Accession #BAF32571); Cry31Aa5 (Accession #BAF32572); Cry31Aa61 (Accession #BA144026); Cry31Ab1 (Accession #BAE79809); Cry31Ab21 (Accession #BAF32570); Cry31Ac1 (Accession #BAF34368); Cry31Ac2 (Accession #AB731600); Cry31Ad1 (Accession #BA144022);

Cry32Aa1 (Accession #AAG36711); Cry32Aa2 (Accession #GU063849); Cry32Ab1 (Accession #GU063850); Cry32Ba1 (Accession #BAB78601); Cry32Ca1 (Accession #BAB78602); Cry32Cb1 (Accession #KC156708); Cry32Da1 (Accession #BAB78603); Cry32Ea1 (Accession #GU324274); Cry32Ea21 (Accession #KC156686); Cry32Eb1 (Accession #KC156663); Cry32Fa1 (Accession #KC156656); Cry32Ga1 (Accession #KC156657); Cry32Ha1 (Accession #KC156661); Cry32Hb1 (Accession #KC156666); Cry32Ia1 (Accession #KCl 56667); Cry32Ja1 (Accession #KCl 56685); Cry32Ka1 (Accession #KCl 56688); Cry32La1 (Accession #KC156689); Cry32Ma1 (Accession #KC156690); Cry32Mb1 (Accession #KC156704); Cry32Na1 (Accession #KC156691); Cry32Oa1 (Accession #KC156703); Cry32Pa1 (Accession #KC156705); Cry32Qa1 (Accession #KC156706); Cry32Ra1 (Accession #KC156707); Cry32Sa1 (Accession #KC156709); Cry32Ta1 (Accession #KC156710); Cry32Ua1 (Accession #KC156655); Cry33Aa1 (Accession #AAL26871); Cry34Aa1 (Accession #AAG50341); Cry34Aa21 (Accession #AAK64560); Cry34Aa3 (Accession #AAT29032); Cry34Aa41 (Accession #AAT29030); Cry34Ab1 (Accession #AAG41671); Cry34Ac1 (Accession #AAG50118); Cry34Ac2 (Accession #AAK64562); Cry34Ac3 (Accession #AAT29029); Cry34Ba1 (Accession #AAK64565); Cry34Ba2 (Accession #AAT29033); Cry34Ba3 (Accession #AAT29031); Cry35Aa1 (Accession #AAG50342); Cry35Aa2 (Accession #AAK64561); Cry35Aa3 (Accession #AAT29028); Cry35Aa4 (Accession #AAT29025); Cry35Ab1 (Accession #AAG41672); Cry35Ab2 (Accession #AAK64563); Cry35Ab3 (Accession #AY536891); Cry35Ac1 (Accession #AAG50117); Cry35Ba1 (Accession #AAK64566); Cry35Ba2 (Accession #AAT29027); Cry35Ba3 (Accession #AAT29026); Cry36Aa1 (Accession #AAK64558); Cry37 Aa1 (Accession #AAF76376); Cry38Aa1 (Accession #AAK64559); Cry39Aa1 (Accession #BAB72016); Cry40Aa1 (Accession #BAB72018); Cry40Ba1 (Accession #BAC77648); Cry40Ca1 (Accession #EU381045); Cry40Da1 (Accession #ACF15199); Cry41Aa1 (Accession #BAD35157); Cry41Ab1 (Accession #BAD35163); Cry41Ba1 (Accession #HM461871); Cry41Ba2 (Accession #ZP_04099652); Cry42Aa1 (Accession #BAD35166); Cry43Aa1 (Accession #BAD15301); Cry43Aa21 (Accession #BAD95474); Cry43Ba1 (Accession #BAD15303); Cry43Ca1 (Accession #KC156676); Cry43Cb1 (Accession #KC156695); Cry43Cc1 (Accession #KC156696); Cry43-like (Accession #BAD15305); Cry44Aa (Accession #BAD08532); Cry45Aa (Accession #BAD22577); Cry46Aa (Accession #BAC79010); Cry46Aa2 (Accession #BAG68906); Cry46Ab (Accession #BAD35170); Cry47 Aa (Accession #AAY24695); Cry48Aa (Accession #CAJ18351); Cry48Aa2 (Accession #CAJ86545); Cry48Aa3 (Accession #CAJ86546); Cry48Ab (Accession #CAJ86548); Cry48Ab21 (Accession #CAJ86549); Cry49Aa (Accession #CAH56541); Cry49Aa2 (Accession #CAJ86541); Cry49Aa3 (Accession #CAJ86543); Cry49Aa41 (Accession #CAJ86544); Cry49Ab1 (Accession #CAJ86542); Cry50Aa1 (Accession #BAE86999); Cry50Ba1 (Accession #GU446675); Cry50Ba2 (Accession #GU446676); Cry51Aa1 (Accession #AB114444); Cry51Aa2 (Accession #GU570697); Cry52Aa1 (Accession #EF613489); Cry52Ba1 (Accession #FJ361760); Cry53Aa1 (Accession #EF633476); Cry53Ab1 (Accession #FJ361759); Cry54Aa1 (Accession #ACA52194); Cry54Aa2 (Accession #GQ140349); Cry54Ba1 (Accession #GU446677); Cry55Aa1 (Accession #ABW88932); Cry54Ab1 (Accession #JQ916908); Cry55Aa2 (Accession #AAE33526); Cry56Aa1 (Accession #ACU57499); Cry56Aa21 (Accession #GQ483512); Cry56Aa3 (Accession #JX025567); Cry57Aa1 (Accession #ANC87261); Cry58Aa1 (Accession #ANC87260); Cry59Ba1 (Accession #JN790647); Cry59Aa1 (Accession #ACR43758); Cry60Aa1 (Accession #ACU24782); Cry60Aa2 (Accession #EA057254); Cry60Aa3 (Accession #EEM99278); Cry60Ba1 (Accession #GU810818); Cry60Ba21 (Accession #EA057253); Cry60Ba3 (Accession #EEM99279); Cry61Aa1 (Accession #HM035087); Cry61Aa2 (Accession #HM132125); Cry61Aa3 (Accession #EEM19308); Cry62Aa1 (Accession #HM054509); Cry63Aa1 (Accession #BA144028); Cry64Aa1 (Accession #BAJ05397); Cry65Aa1 (Accession #HM461868); Cry65Aa2 (Accession #ZP_04123838); Cry66Aa1 (Accession #HM485581); Cry66Aa2 (Accession #ZP_04099945); Cry67Aa1 (Acces-sion #HM485582); Cry67Aa2 (Accession #ZP_04148882); Cry68Aa1 (Acces-sion #HQ113114); Cry69Aa1 (Accession #HQ401006); Cry69Aa2 (Accession #JQ821388); Cry69Ab1 (Accession #JN209957); Cry70Aa1 (Accession #JN646781); Cry70Ba1 (Accession #AD051070); Cry70Bb1 (Accession #EEL67276); Cry71Aa1 (Accession #JX025568); Cry72Aa1 (Accession #JX025569); Cyt1Aa (GenBank Accession Number X03182); Cyt1Ab (GenBank Accession Number X98793); Cyt1B (GenBank Accession Number U37196); Cyt2A (GenBank Accession Number Z14147); and Cyt2B (GenBank Accession Number U52043).

Examples of δ-endotoxins also include but are not limited to Cry1A proteins of U.S. Pat. Nos. 5,880,275, 7,858,849 8,530,411, 8,575,433, and 8,686,233; a DIG-3 or DIG-11 toxin (N-terminal deletion of α-helix 1 and/or α-helix 2 variants of cry proteins such as Cry1A, Cry3A) of U.S. Pat. Nos. 8,304,604, 8,304,605 and 8,476,226; Cry1B of U.S. patent application Ser. No. 10/525,318; Cry1C of U.S. Pat. No. 6,033,874; Cry1F of U.S. Pat. Nos. 5,188,960 and 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein includ-ing but not limited to an engineered hybrid insecticidal protein (eHIP) created by fusing unique combinations of variable regions and conserved blocks of at least two dif-ferent Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E and Cry9F families, including but not limited to the Cry9D protein of U.S. Pat. No. 8,802,933 and the Cry9B protein of U.S. Pat. No. 8,802,934; a Cry15 protein of Naimov, et al., (2008), "Applied and Environmental Microbiology," 74:7145-7151; a Cry22, a Cry34Ab1 protein of U.S. Pat. Nos. 6,127,180, 6,624,145 and 6,340,593; a CryET33 and cryET34 protein of U.S. Pat. Nos. 6,248,535, 6,326,351, 6,399,330, 6,949, 626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry51 protein, a Cry binary toxin; a TIC901 or related toxin; TIC807 of US Patent Application Publication Number 2008/0295207; ET29, ET37, TIC809, TIC810, TIC812, TIC127, TIC128 of PCT US 2006/033867; TIC853 toxins of U.S. Pat. No. 8,513,494, AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI- 020 and AXMI-021 of WO 2006/083891; AXMI-010 of WO 2005/038032; AXMI-003 of WO 2005/021585; AXMI-008 of US Patent Application Publication Number 2004/0250311; AXMI-006 of US Patent Application Publication Number 2004/0216186; AXMI-007 of US Patent Application Publication Number 2004/0210965; AXMI-009 of US Patent Application Number 2004/0210964; AXMI-014 of US Patent Application Publication Number 2004/0197917; AXMI-004 of US Patent Application Publication Number 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of US Patent Application Publication Number 2011/0263488; AXMI-R1 and related proteins of US Patent Application Publication Number 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230 and AXMI231 of WO 2011/103247 and U.S. Pat. No. 8,759,619; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2010/0298211; AXMI-066 and AXMI-076 of US Patent Application Publication Number 2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US Patent Application Publication Number 2010/0005543, AXMI270 of US Patent Application Publication US20140223598, AXMI279 of US Patent Application Publication US20140223599, cry proteins such as Cry1A and Cry3A having modified proteolytic sites of U.S. Pat. No. 8,319,019; a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art. See, N. Crickmore, et al., "Revision of the Nomenclature for the *Bacillus thuringiensis* Pesticidal Crystal Proteins," Microbiology and Molecular Biology Reviews," (1998) Vol 62:807-813; see also, N. Crickmore, et al., "*Bacillus thuringiensis* toxin nomenclature" (2016), at www.btnomenclature.info/.

The use of Cry proteins as transgenic plant traits is well known to one skilled in the art and Cry-transgenic plants including but not limited to plants expressing Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval. See, Sanahuja et al., "*Bacillus thuringiensis*: a century of research, development and commercial applications," (2011) Plant Biotech Journal, April 9 (3): 283-300 and the CERA (2010) GM Crop Database Center for Environmental Risk Assessment (CERA), ILSI Research Foundation, Washington D.C. at cera-gmc.org/index.php?action=gm_crop_database, which can be accessed on the world-wide web using the "www" prefix). More than one pesticidal proteins well known to one skilled in the art can also be expressed in plants such as Vip3Ab & Cry1Fa (US2012/0317682); Cry1BE & Cry1F (US2012/0311746); Cry1CA & Cry1AB (US2012/0311745); Cry1F & CryCa (US2012/0317681); Cry1DA& Cry1BE (US2012/0331590); Cry1DA & Cry1Fa (US2012/0331589); Cry1AB & Cry1BE (US2012/0324606); Cry1Fa & Cry2Aa and Cry1I & Cry1E (US2012/0324605); Cry34Ab/35Ab and Cry6Aa (US20130167269); Cry34Ab/VCry35Ab & Cry3Aa (US20130167268); Cry1Ab & Cry1F (US20140182018); and Cry3A and Cry1Ab or Vip3 Aa (US20130116170). Pesticidal proteins also include insecticidal lipases including lipid acyl hydrolases of U.S. Pat. No. 7,491,869, and cholesterol oxidases such as from *Streptomyces* (Purcell et al. (1993) Biochem Biophys Res Commun 15:1406-1413).

Pesticidal proteins also include VIP (vegetative insecticidal proteins) toxins. Entomopathogenic bacteria produce insecticidal proteins that accumulate in inclusion bodies or parasporal crystals (such as the aforementioned Cry and Cyt proteins), as well as insecticidal proteins that are secreted into the culture medium. Among the latter are the Vip proteins, which are divided into four families according to their amino acid identity. The Vip1 and Vip2 proteins act as binary toxins and are toxic to some members of the Coleoptera and Hemiptera. The Vip1 component is thought to bind to receptors in the membrane of the insect midgut, and the Vip2 component enters the cell, where it displays its ADP-ribosyltransferase activity against actin, preventing microfilament formation. Vip3 has no sequence similarity to Vip1 or Vip2 and is toxic to a wide variety of members of the Lepidoptera. Its mode of action has been shown to resemble that of the Cry proteins in terms of proteolytic activation, binding to the midgut epithelial membrane, and pore formation, although Vip3A proteins do not share binding sites with Cry proteins. The latter property makes them good candidates to be combined with Cry proteins in transgenic plants (*Bacillus thuringiensis*-treated crops [Bt crops]) to prevent or delay insect resistance and to broaden the insecticidal spectrum. There are commercially grown varieties of Bt cotton and Bt maize that express the Vip3 Aa protein in combination with Cry proteins. For the most recently reported Vip4 family, no target insects have been found yet. See, Chakroun et al., "Bacterial Vegetative Insecticidal Proteins (Vip) from Entomopathogenic Bacteria," Microbiol Mol Biol Rev. 2016 Mar. 2; 80 (2): 329-50. VIPs can be found in U.S. Pat. Nos. 5,877,012, 6,107,279 6,137, 033, 7,244,820, 7,615,686, and 8,237,020 and the like. Other VIP proteins are well known to skilled in the art one (see, lifesci.sussex.ac.uk/home/Neil_Crickmore/Bt/vip.html, which can be accessed on the world-wide web using the "www" prefix).

Pesticidal proteins also include toxin complex (TC) proteins, obtainable from organisms such as *Xenorhabdus, Photorhabdus* and *Paenibacillus* (see, U.S. Pat. Nos. 7,491, 698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptBIXb and XptCI Wi. Examples of Class C proteins are TccC, XptClXb and XptBl Wi. Pesticidal proteins also include spider, snake and scorpion venom proteins. Examples of spider venom peptides include, but are not limited to lycotoxin-1 peptides and mutants thereof (U.S. Pat. No. 8,334,366).

Some currently registered PIPs are listed in Table 11. Transgenic plants have also been engineered to express dsRNA directed against insect genes (Baum, J. A. et al. (2007) Control of coleopteran insect pests through RNA interference. Nature Biotechnology 25:1322-1326; Mao, Y. B. et al. (2007) Silencing a cotton bollworm P450 monooxygenase gene by plant-mediated RNAi impairs larval tolerance of gossypol. Nature Biotechnology 25:1307-1313). RNA interference can be triggered in the pest by feeding of the pest on the transgenic plant. Pest feeding thus causes injury or death to the pest.

TABLE 11

List of exemplary Plant-incorporated Protectants, which
can be combined with microbes of the disclosure

| Plant-Incorporated Protectants (PIPs) | Company and Trade Names | Pesticide Registration Numbers |
|---|---|---|
| Potato | Potato | |
| Cry3A Potato PC Code 006432 | Naturemark New Leaf Monsanto | 524-474 |
| Cry3A & PLRV Potato PC Codes 006432, 006469 | Monsanto New Leaf Plus | 524-498 |
| Corn | | |
| Cry1Ab Corn Event 176 PC Code 006458 | Mycogen Seeds/Dow Agro Syngenta Seeds | 68467-1 66736-1 |
| Cry1Ab Corn Event Bt11 EPA PC Code 006444 OECD Unique Identifier SYN-BTØ11-1, | Agrisure CB (with Yieldgard) Attribute Insect Protected Sweet Corn Syngenta Seeds | 67979-1 65268-1 |
| Cry1Ab Corn Event MON 801 | Monsanto | 524-492 |
| Cry1Ab corn Event MON 810 PC Code 006430 OECD Unique Identifier MON-ØØ81Ø-6 | Monsanto | 524-489 |
| Cry1Ac Corn PC Code 006463 | Dekalb Genetics c/o Monsanto BT-XTRA | 69575-2 |
| Cry1F corn Event TC1507 PC Code 006481 OECD Unique Identifier DAS-Ø15Ø7-1 | Mycogen Seeds/Dow Agro Pioneer Hi-Bred/Dupont | 68467-2 29964-3 |
| moCry1F corn Event DAS-Ø6275-8 PC Code 006491 OECD Unique Identifier DAS-Ø6275-8 | Mycogen Seeds/Dow Agro | 68467-4 |
| Cry9C Corn | Aventis StarLink | 264-669 |
| Cry3Bb1 corn Event MON863 PC Code 006484 OECD Unique Identifier MON-ØØ863-5 | Monsanto YielGard RW | 524-528 |
| Cry3Bb1 corn Event MON 88017 PC Code 006498 OECD Unique Identifier MON-88Ø17-3 | Monsanto YieldGrad VT Rootworm | 524-551 |
| Cry34Ab1/Cry35Ab1 corn Event DAS-591227-7 PC Code 006490 OECD Unique Identifier DAS-59122-7 | Mycogen Seeds/Dow Agro Pioneer Hi-Bred/Dupont Herculex Rootworm | 68467-5 29964-4 |
| Cry34Ab1/Cry35Ab1 and Cry1F corn Event 4114 PC Codes 006555, 006556 | Pioneer Hi-Bred/Dupont | 29964-17 |
| mCry3A corn Event MIR 604 PC Code 006509 OECD Unique Identifier SYN-IR604-8 | Syngenta Seeds Agrisure RW | 67979-5 |
| Cry1A.105 and Cry2Ab2 corn Event MON 89034 PC Codes 006515 and 006514 | Monsanto Genuity VT Double Pro | 524-575 |
| Vip3Aa20 corn Event MIR 162 PC Code 006599 OECD Unique Identifier SYN-IR162-4 | Syngenta Seeds Agrisure Viptera | 67979-14 |

TABLE 11-continued

List of exemplary Plant-incorporated Protectants, which
can be combined with microbes of the disclosure

| Plant-Incorporated Protectants (PIPs) | Company and Trade Names | Pesticide Registration Numbers |
|---|---|---|
| eCry3.1Ab corn in Event 5307 PC Code 016483 OECD Unique Identifier SYN-Æ53Æ7-1 Stacked Events and Seed Blend Corn | Syngenta | 67979-22 |
| MON863 × MON810 with Cry3Bb1 + Cry1Ab | Monsanto YieldGard Plus | 524-545 |
| DAS-59122-7 × TC1507 with Cry34Ab1/Cry35Ab1 + Cry1F | Mycogen Seeds/Dow Agro Pioneer Hi-Bred/Dupont Herculex Xtra | 68467-6 29964-5 |
| MON 88017 × MON 810 with Cry1AB + Cry3Bb | Monsanto YieldGard VT Triple YieldGard VT Plus | 524-552 |
| MIR 604 × Bt11 with mCry3A + Cry1Ab | Syngenta Agrisure CB/RW Agrisure 3000GT | 67979-8 |
| Mon 89034 × Mon 88017 with Cry1A.105 + Cry2Ab2 + Cry3Bb1 | Monsanto Genuity VT Triple PRO | 524-576 |
| Bt11 × MIR 162 with Cry1Ab + Vip3Aa 20 | Syngenta Seeds Agrisure 2100 | 67979-12 |
| Bt11 × MIR 162 × MIR 604 with Cry1Ab + Vip3Aa20 + mCry3A | Syngenta Seeds Agrisure 3100 | 67979-13 |
| MON 89034 × TC1507 × MON 88017 × DAS-59122-7 with Cry1A.105 + Cry2Ab2 + Cry1F + Cry3Bb1 + Cry34Ab1/Cry35Ab1 | Monsanto Company Mycogen Seeds/Dow Agro Genuity SmartStax SmartStax | 524-581 68467-7 |
| MON 89034 × TC1507 × MON 88017 × DAS-59122-7 Seed Blend | Monsanto Company Mycogen Seeds/Dow Agro Genuity SmartStax RIB Complete SmartStax Refuge Advanced; Refuge Advanced Powered by SmartStax | 524-595 68467-16 |
| Seed Blend of Herculex Xtra + Herculex I | Pioneer Hi-Bred/Dupont Optimum AcreMax1 Insect Protection | 29964-6 |
| Seed Blend of Herculex RW + Non-Bt corn | Pioneer Hi-Bred/Dupont Optimum AcreMax RW | 29964-10 |
| (Cry1F × Cry34/35 × Cry1Ab) - seed blend | Pioneer Hi-Bred/Dupont Optimum AcreMax Xtra | 29964-11 |
| (Cry1F × Cry1Ab) - seed blend | Pioneer Hi-Bred/Dupont Optimum AcreMax Insect Protection | 29964-12 |
| (Cry1F × mCry3A) | Pioneer Hi-Bred/Dupont Optimum Trisect | 29964-13 |
| (Cry1F × Cry34/35 × Cry1Ab × mCry3A) | Pioneer Hi-Bred/Dupont Optimum Intrasect Xtreme | 29964-14 |
| 59122 × MON 810 × MIR 604 (Cry34/35 × Cry1Ab × mCry3A) | Pioneer Hi-Bred/Dupont | 29964-15 |
| Optimum AcreMax Xtreme (Cry1F × Cry34/35 × Cry1Ab × mCry3A) - seed blend | Pioneer Hi-Bred/Dupont Optimum AcreMax Xtreme (seed blend) | 29964-16 |
| MON 810 × MIR 604 (Cry1Ab × mCry3A) | Pioneer Hi-Bred/Dupont | 29964-18 |
| 1507 × MON810 × MIR 162 (Cry1F × Cry1Ab × Vip 3Aa20) | Pioneer Hi-Bred/Dupont Optimum Intrasect Leptra | 29964-19 |
| 1507 × MIR 162 (Cry1F × Vip30Aa20) | Pioneer Hi-Bred/Dupont | 29964-20 |

TABLE 11-continued

List of exemplary Plant-incorporated Protectants, which
can be combined with microbes of the disclosure

| Plant-Incorporated Protectants (PIPs) | Company and Trade Names | Pesticide Registration Numbers |
|---|---|---|
| 4114 × MON 810 × MIR 604 (Cry34/35 × Cry1F × Cry1Ab × mCry3A) - seed blend | Pioneer Hi-Bred/Dupont | 29964-21 |
| 4114 × MON 810 × MIR 604 (Cry34/35 × Cry1F × Cry1Ab × mCry3A) | Pioneer Hi-Bred/Dupont | 29964-22 |
| 1507 × MON810 × MIR 604 (Cry1F × Cry1Ab × mCry3A) - seed blend | Pioneer Hi-Bred/Dupont Optimum AcreMax Trisect | 29964-23 |
| 1507 × MON810 × MIR 604 (Cry1F × Cry1Ab × mCry3A) | Pioneer Hi-Bred/Dupont Optimum Intrasect Trisect | 29964-24 |
| 4114 × MON 810 (Cry34/35 × Cry1F × Cry1Ab) | Pioneer Hi-Bred/Dupont | 29964-25 |
| 1507 × MON810 × MIR 162 (Cry1F × Cry1Ab × Vip 3Aa20) - seed blend | Pioneer Hi-Bred/Dupont Optimum AcreMax Leptra | 29964-26 |
| SmartStax Intermediates (8 products) | Monsanto | 524-583, 524-584, 524-586, 524-587, 524-588, 524-589, 524-590 |
| MON 89034 × 1507 (Cry1A.105 × Cry2Ab2 × Cry1F) | Monsanto Genuity PowerCore | 524-585 |
| MON 89034 (Cry1A.105 × Cry2Ab2) - seed blend | Monsanto Genuity VT Double PRO RIB Complete | 524-597 |
| MON 89034 × 88017 RIB Complete (Cry1A.105 × Cry2Ab2 × Cry3Bb1) - seed blend | Monsanto Genuity VT Triple PRO RIB Complete | 524-606 |
| MON 89034 × 1507 (Cry1A.105 × Cry2Ab2 × Cry1F) - seed blend | Monsanto Genuity PowerCore RIB Complete | 524-612 |
| Bt11 × MIR162 × 1507 (Cry1Ab × Vip3Aa20 × Cry1F) | Syngenta Seeds Agrisure Viptera 3220 Refuge Renew | 67979-15 |
| Bt11 × 59122-7 × MIR 604 × 1507 (Cry1Ab × Cry34/35 × mCry3A × Cry1F) | Syngenta Seeds Agrisure 3122 | 67979-17 |
| Bt11 × MIR162 × TC1507 (Cry1Ab × Vip3Aa20 × Cry1F) - seed blend | Syngenta Seeds Agisure Viptera 3220 (E-Z Refuge) (Refuge Advanced) | 67979-19 |
| Bt11 × DAS 59122-7 × MIR604 × TC1507 (Cry1Ab × Cry34/35 × mCry3A × Cry1F) - seed blend | Syngenta Seeds Agisure Viptera 3122 (E-Z Refuge) (Refuge Advanced) | 67979-20 |
| Bt11 × MIR 162 × MIR 604 × TC1507 × 5307 (Cry1Ab × Vip3Aa20 × mCry3A × Cry1F × eCry3.1Ab) | Syngenta Seeds Agrisure Duracade (Refuge Renew) 5222 | 67979-23 |
| Bt11 × MIR 604 × TC1507 × 5307 (Cry1Ab × mCry3A × Cry1F × eCry3.1Ab) | Syngenta Seeds Agrisure Duracade (Refuge Renew) 5122 | 67979-24 |
| Bt11 × MIR 604 × TC1507 × 5307 (Cry1Ab × mCry3A × Cry1F × eCry3.1Ab) - seed blend | Syngenta Seeds Agisure Duracade 5122 E-Z Refuge | 67979-25 |
| Bt11 × MIR 162 × MIR 604 × TC1507 × 5307 (Cry1Ab × Vip3Aa20 × mCry3A × Cry1F × eCry3.1Ab) - seed blend | Syngenta Seeds Agisure Duracade 5222 E-Z Refuge | 67979-26 |
| Bt11 × MIR 162 × MIR 604 × TC1507 × 5307 (Cry1Ab × Vip3Aa20 × mCry3A × Cry1F × eCry3.1Ab) | Syngenta Seeds Agrisure Duracade (Refuge Renew) 5022 | 67979-27 |
| MIR604 × DAS-59122-7 × TC1507 (mCry3A × Cry34/35 × Cry1F) | Syngenta Seeds | 67979-29 |
| SmartStax Intermediates (8 products) | Mycogen Seeds/Dow Agro | 68467-8, 68467-9, 68467-10, 68467-11, 68467-13, 68467-14, 68467-15 |
| MON 89034 × 1507 (Cry1A.105 × Cry2Ab2 × Cry1F) | Mycogen Seeds/Dow Agro PowerCore; PowerCore Enlist | 68467-12 |

TABLE 11-continued

| List of exemplary Plant-incorporated Protectants, which can be combined with microbes of the disclosure | | |
| --- | --- | --- |
| Plant-Incorporated Protectants (PIPs) | Company and Trade Names | Pesticide Registration Numbers |
| MON 89034 × 1507 (Cry1A.105 × Cry2Ab2 × Cry1F) - seed blend | Mycogen Seeds/Dow Agro PowerCore Refuge Advanced; Refuge Advanced Powered by PowerCore | 68467-21 |
| 1507 × MON 810 | Pioneer Hi-Bred/Dupont Optimum Intrasect | 29964-7 |
| 59122 × 1507 × MON 810 | Pioneer Hi-Bred/Dupont | 29964-8 |
| 59122 × MON 810 | Pioneer Hi-Bred/Dupont | 29964-9 |
| Cotton | | |
| Cry1Ac Cotton | Monsanto BollGard | 524-478 |
| Cry1Ac and Cry2Ab2 in Event 15985 Cotton PC Codes 006445, 006487 | Monsanto BollGard II | 524-522 |
| Bt cotton Event MON531 with Cry1Ac (breeding nursery use only) | Monsanto | 524-555 |
| Bt cotton Event MON15947 with Cry2Ab2 (breeding nursery use only) | Monsanto | 524-556 |
| COT102 × MON 15985 (Vip3Aa19 × Cry1Ac × Cry2Ab2) | Monsanto Bollgard III | 524-613 |
| Cry1F and Cry1Ac (Events DAS-21023-5 × DAS-24236-5) Cotton PC Codes 006512, 006513 | Mycogen Seeds/Dow Agro Widestrike | 68467-3 |
| Event 3006-210-23 (Cry1Ac) | Mycogen Seeds/Dow Agro | 68467-17 |
| Event 281-24-236 (Cry1F) | Mycogen Seeds/Dow Agro | 68467-18 |
| WideStrike × COT102 (Cry1F × Cry1Ac × Vip3Aa19) | Mycogen Seeds/Dow Agro WideStrike 3 | 68467-19 |
| Vip3Aa19 and FLCry1Ab (Events Cot102 × Cot67B) Cotton PC Codes 016484, 016486 OECD Unique Identifier SYN-IR102-7 X SYN-IR67B-1 | Syngenta Seeds (Formally VipCot) | 67979-9 |
| COT102 (Vip3Aa19) | Syngenta Seeds | 67979-18 |
| COT67B (FLCry1Ab) | Syngenta Seeds | 67979-21 |
| T304-40 (Cry1Ab) | Bayer CropScience | 264-1094 |
| GHB119 (Cry2Ae) | Bayer CropScience | 264-1095 |
| T304-40 × GHB119 (Cry1Ab × Cry2Ae) OECD Unique Identifier: BCS-GHØØ4-7 × BCS-GHØØ5-8 | Bayer CropScience TwinLink | 264-1096 |
| Soybean | | |
| Cry1Ac in Event 87701 Soybean PC Code 006532 OECD Unique Identifier | Monsanto Inacta | 524-594 |
| Cry1A.105 and Cry2Ab2 in Event 87751 Soybean PC Codes 006614, 006615 OECD Unique Identifier MON-87751-7 | Monsanto | 524-619 |
| Cry1Ac × Cry1F in Event DAS 81419 Soybean PC Codes 006527, 006528 OECD Unique Identifier DAS 81419 (Cry1Ac × Cry1F) | Mycogen Seeds/Dow Agro | 68467-20 |

In some embodiments, any one or more of the pesticides set forth herein may be utilized with any one or more of the microbes of the disclosure and can be applied to plants or parts thereof, including seeds.

Herbicides

As aforementioned, agricultural compositions of the disclosure, which may comprise any microbe taught herein, are sometimes combined with one or more herbicides.

Compositions comprising bacteria or bacterial populations produced according to methods described herein and/ or having characteristics as described herein may further include one or more herbicides. In some embodiments, herbicidal compositions are applied to the plants and/or plant parts. In some embodiments, herbicidal compositions may be included in the compositions set forth herein, and can be applied to a plant(s) or a part(s) thereof simultaneously or in succession, with other compounds.

Herbicides include 2,4-D, 2,4-DB, acetochlor, acifluorfen, alachlor, ametryn, atrazine, aminopyralid, benefin, bensulfuron, bensulide, bentazon, bicyclopyrone, bromacil, bromoxynil, butylate, carfentrazone, chlorimuron, chlorsulfuron, clethodim, clomazone, clopyralid, cloransulam, cycloate, DCPA, desmedipham, dicamba, dichlobenil, diclofop, diclosulam, diflufenzopyr, dimethenamid, diquat, diuron, DSMA, endothall, EPTC, ethalfluralin, ethofume-sate, fenoxaprop, fluazifop-P, flucarbzone, flufenacet, flumetsulam, flumiclorac, flumioxazin, fluometuron, fluroxypyr, fomesafen, foramsulfuron, glufosinate, glyphosate, halosulfuron, hexazinone, imazamethabenz, imazamox, imazapic, imazaquin, imazethapyr, isoxaflutole, lactofen, linuron, MCPA, MCPB, mesotrione, metolachlor-s, metribuzin, indaziflam, metsulfuron, molinate, MSMA, napropamide, naptalam, nicosulfuron, norflurazon, oryzalin, oxadiazon, oxyfluorfen, paraquat, pelargonic acid, pendimethalin, phenmedipham, picloram, primisulfuron, prodiamine, prometryn, pronamide, propanil, prosulfuron, pyrazon, pyrithioac, quinclorac, quizalofop, rimsulfuron, S-metolachlor, sethoxydim, siduron, simazine, sulfentrazone, sulfometuron, sulfosulfuron, tebuthiuron, tembotrione, terbacil, thiazopyr, thifensulfuron, thiobencarb, topramezone, tralkoxydim, triallate, triasulfuron, tribenuron, triclopyr, trifluralin, and triflusulfuron.

In some embodiments, any one or more of the herbicides set forth herein may be utilized with any one or more of the plants or parts thereof set forth herein.

Herbicidal products may include CORVUS, BALANCE FLEXX, CAPRENO, DIFLEXX, LIBERTY, LAUDIS, AUTUMN SUPER, and DIFLEXX DUO.

In some embodiments, any one or more of the herbicides set forth in the below Table 12 may be utilized with any one or more of the microbes taught herein, and can be applied to any one or more of the plants or parts thereof set forth herein.

TABLE 12

| List of exemplary herbicides, which can be combined with microbes of the disclosure | | | |
|---|---|---|---|
| Site of Action | Herbicide Group Number | Chemical Family | Herbicide |
| ACCase inhibitors | 1 | Cyclohexanediones | Sethoxydim (Poast, Poast Plus) |
| | | | Clethodim (Select, Select Max, Arrow) |
| | | Aryloxyphenoxypropionates | Fluazifop (Fusilade DX, component in Fusion) |
| | | | Fenoxaprop (Puma, component in Fusion) |
| | | | Quizalofop (Assure II, Targa) |
| | | Phenylpyrazolins | Pinoxaden (Axial XL) |
| ALS inhibitors | 2 | Imidazolinones | Imazethapyr (Pursuit) |
| | | | Imazamox (Raptor) |
| | | Sulfonylureas | Chlorimuron (Classic) |
| | | | Halosulfuron (Permit, Sandea) |
| | | | Iodosulfuron (component in Autumn Super) |
| | | | Mesosulfuron (Osprey) |
| | | | Nicosulfuron (Accent Q) |
| | | | Primisulfuron (Beacon) |
| | | | Prosulfuron (Peak) |
| | | | Rimsulfuron (Matrix, Resolve) |
| | | | Thifensulfuron (Harmony) |
| | | | Tribenuron (Express) |
| | | | Triflusulfuron (UpBeet) |
| | | Triazolopyrimidine | Flumetsulam (Python) |
| | | | Cloransulam-methyl (FirstRate) |
| | | | Pyroxsulam (PowerFlex HL) |
| | | | Florasulam (component in Quelex) |
| | | Sulfonylaminocarbonyltriazolinones | Propoxycarbazone (Olympus) |
| | | | Thiencarbazone-methyl (component in Capreno) |
| Microtubule inhibitors (root inhibitors) | 3 | Dinitroanilines | Trifluralin (many names) |
| | | | Ethalfluralin (Sonalan) |
| | | | Pendimethalin (Prowl/Prowl H$_2$O) |
| | | Benzamide | Pronamide (Kerb) |
| Synthetic auxins | 4 | Arylpicolinate | Halauxifen (Elevore, component in Quelex) |
| | | Phenoxy acetic acids | 2,4-D (Enlist One, others) |
| | | | 2,4-DB (Butyrac 200, Butoxone 200) |
| | | | MCPA |

TABLE 12-continued

| List of exemplary herbicides, which can be combined with microbes of the disclosure | | | |
|---|---|---|---|
| Site of Action | Herbicide Group Number | Chemical Family | Herbicide |
| | | Benzoic acids | Dicamba (Banvel, Clarity, DiFlexx, Engenia, XtendiMax; component in Status) |
| | | Pyridines | Clopyralid (Stinger) Fluroxypyr (Starane Ultra) |
| Photosystem II inhibitors | 5 | Triazines | Atrazine Simazine (Princep, Sim-Trol) |
| | | Triazinone | Metribuzin (Metribuzin, others) Hexazinone (Velpar) |
| | | Phenyl-carbamates | Desmedipham (Betenex) Phenmedipham (component in Betamix) |
| | | Uracils | Terbacil (Sinbar) |
| | 6 | Benzothiadiazoles | Bentazon (Basagran, others) |
| | | Nitriles | Bromoxynil (Buctril, Moxy, others) |
| | 7 | Phenylureas | Linuron (Lorox, Linex) |
| Lipid synthesis inhibitor | 8 | Thiocarbamates | EPTC (Eptam) |
| EPSPS inhibitor | 9 | Organophosphorus | Glyphosate |
| Glutamine synthetase inhibitor | 10 | Organophosphorus | Glufosinate (Liberty, Rely) |
| Diterpene biosynthesis inhibitor (bleaching) | 13 | Isoxazolidinone | Clomazone (Command) |
| Protoporphyrinogen oxidase inhibitors (PPO) | 14 | Diphenylether | Acifluorfen (Ultra Blazer) Fomesafen (Flexstar, Reflex) Lactofen (Cobra, Phoenix) |
| | | N-phenylphthalimide | Flumiclorac (Resource) Flumioxazin (Valor, Valor EZ, Rowel) |
| | | Aryl triazolinone | Sulfentrazone (Authority, Spartan) Carfentrazone (Aim) Fluthiacet-methyl (Cadet) |
| | | Pyrazoles | Pyraflufen-ethyl (Vida) |
| | | Pyrimidinedione | Saflufenacil (Sharpen) |
| Long-chain fatty acid inhibitors | 15 | Acetamides | Acetochlor (Harness, Surpass NXT, Breakfree NXT, Warrant) Dimethenamid-P (Outlook) Metolachlor (Parallel) Pyroxasulfone (Zidua, Zidua SC) s-metolachlor (Dual Magnum, Dual II Magnum, Cinch) Flufenacet (Define) |
| Specific site unknown | 16 | Benzofuranes | Ethofumesate (Nortron) |
| Auxin transport inhibitor | 19 | Semicarbazone | diflufenzopyr (component in Status) |
| Photosystem I inhibitors | 22 | Bipyridiliums | Paraquat (Gramoxone, Parazone) Diquat (Reglone) |
| 4-HPPD inhibitors (bleaching) | 27 | Isoxazole Pyrazole Pyrazolone Triketone | Isoxaflutole (Balance Flexx) Pyrasulfotole (component in Huskie) Topramezone (Armezon/Impact) Bicyclopyrone |

TABLE 12-continued

List of exemplary herbicides, which can be combined with microbes of the disclosure

| Site of Action | Herbicide Group Number | Chemical Family | Herbicide |
|---|---|---|---|
| | | | (component in Acuron) Mesotrione (Callisto) Tembotrione (Laudis) |

Fungicides

As aforementioned, agricultural compositions of the disclosure, which may comprise any microbe taught herein, are sometimes combined with one or more fungicides.

Compositions comprising bacteria or bacterial populations produced according to methods described herein and/or having characteristics as described herein may further include one or more fungicides. In some embodiments, fungicidal compositions may be included in the compositions set forth herein, and can be applied to a plant(s) or a part(s) thereof simultaneously or in succession, with other compounds. The fungicides include azoxystrobin, captan, carboxin, ethaboxam, fludioxonil, mefenoxam, fludioxonil, thiabendazole, thiabendaz, ipconazole, mancozeb, cyazofamid, zoxamide, metalaxyl, PCNB, metaconazole, pyraclostrobin, *Bacillus subtilis* strain QST 713, sedaxane, thiamethoxam, fludioxonil, thiram, tolclofos-methyl, trifloxystrobin, *Bacillus subtilis* strain MBI 600, pyraclostrobin, fluoxastrobin, *Bacillus pumilus* strain QST 2808, chlorothalonil, copper, flutriafol, fluxapyroxad, mancozeb, gludioxonil, penthiopyrad, triazole, propiconaozole, prothioconazole, tebuconazole, fluoxastrobin, pyraclostrobin, picoxystrobin, qols, tetraconazole, trifloxystrobin, cyproconazole, flutriafol, SDHI, EBDCs, sedaxane, MAXIM QUATTRO (gludioxonil, mefenoxam, azoxystrobin, and thiabendaz), RAXIL (tebuconazole, prothioconazole, metalaxyl, and ethoxylated tallow alkyl amines), and benzovindiflupyr.

In some embodiments, any one or more of the fungicides set forth herein may be utilized with any one or more of the plants or parts thereof set forth herein.

Nematicides

As aforementioned, agricultural compositions of the disclosure, which may comprise any microbe taught herein, are sometimes combined with one or more nematicides.

Compositions comprising bacteria or bacterial populations produced according to methods described herein and/or having characteristics as described herein may further include one or more nematicide. In some embodiments, nematicidal compositions may be included in the compositions set forth herein, and can be applied to a plant(s) or a part(s) thereof simultaneously or in succession, with other compounds. The nematicides may be selected from D-D, 1,3-dichloropropene, ethylene dibromide, 1,2-dibromo-3-chloropropane, methyl bromide, chloropicrin, metam sodium, dazomet, methylisothiocyanate, sodium tetrathiocarbonate, aldicarb, aldoxycarb, carbofuran, oxamyl, ethoprop, fenamiphos, cadusafos, fosthiazate, terbufos, fensulfothion, phorate, DiTera, clandosan, sincocin, methyl iodide, propargyl bromide, 2,5-dihydroxymethyl-3,4-dihydroxypyrrolidine (DMDP), any one or more of the avermectins, sodium azide, furfural, *Bacillus firmus*, abamectrin, thiamethoxam, fludioxonil, clothiandin, salicylic acid, and benzo-(1,2,3)-thiadiazole-7-carbothioic acid S-methyl ester.

In some embodiments, any one or more of the nematicides set forth herein may be utilized with any one or more of the plants or parts thereof set forth herein.

In some embodiments, any one or more of the nematicides, fungicides, herbicides, insecticides, and/or pesticides set forth herein may be utilized with any one or more of the plants or parts thereof set forth herein.

Fertilizers, Nitrogen Stabilizers, and Urease Inhibitors

As aforementioned, agricultural compositions of the disclosure, which may comprise any microbe taught herein, are sometimes combined with one or more of a: fertilizer, nitrogen stabilizer, or urease inhibitor.

In some embodiments, fertilizers are used in combination with the methods and bacteria of the present disclosure. Fertilizers include anhydrous ammonia, urea, ammonium nitrate, and urea-ammonium nitrate (UAN) compositions, among many others. In some embodiments, pop-up fertilization and/or starter fertilization is used in combination with the methods and bacteria of the present disclosure.

In some embodiments, nitrogen stabilizers are used in combination with the methods and bacteria of the present disclosure. Nitrogen stabilizers include nitrapyrin, 2-chloro-6-(trichloromethyl)pyridine, N-SERVE 24, INSTINCT, dicyandiamide (DCD).

In some embodiments, urease inhibitors are used in combination with the methods and bacteria of the present disclosure. Urease inhibitors include N-(n-butyl)-thiophosphoric triamide (NBPT), AGROTAIN, AGROTAIN PLUS, and AGROTAIN PLUS SC. Further, the disclosure contemplates utilization of AGROTAIN ADVANCED 1.0, AGROTAIN DRI-MAXX, and AGROTAIN ULTRA.

Further, stabilized forms of fertilizer can be used. For example, a stabilized form of fertilizer is SUPER U, containing 46% nitrogen in a stabilized, urea-based granule, SUPERU contains urease and nitrification inhibitors to guard from denitrification, leaching, and volatilization. Stabilized and targeted foliar fertilizer such as NITAMIN may also be used herein.

Pop-up fertilizers are commonly used in corn fields. Pop-up fertilization comprises applying a few pounds of nutrients with the seed at planting. Pop-up fertilization is used to increase seedling vigor.

Slow- or controlled-release fertilizer that may be used herein entails: A fertilizer containing a plant nutrient in a form which delays its availability for plant uptake and use after application, or which extends its availability to the plant significantly longer than a reference 'rapidly available nutrient fertilizer' such as ammonium nitrate or urea, ammonium phosphate or potassium chloride. Such delay of initial availability or extended time of continued availability may occur by a variety of mechanisms. These include controlled water solubility of the material by semi-permeable coatings, occlusion, protein materials, or other chemical forms, by slow hydrolysis of water-soluble low molecular weight compounds, or by other unknown means.

Stabilized nitrogen fertilizer that may be used herein entails: A fertilizer to which a nitrogen stabilizer has been added. A nitrogen stabilizer is a substance added to a fertilizer which extends the time the nitrogen component of the fertilizer remains in the soil in the urea-N or ammonia-cal-N form.

Nitrification inhibitor that may be used herein entails: A substance that inhibits the biological oxidation of ammonia-cal-N to nitrate-N. Some examples include: (1) 2-chloro-6-(trichloromethyl-pyridine), common name Nitrapyrin, manufactured by Dow Chemical; (2) 4-amino-1,2,4-6-triaz-ole-HCl, common name ATC, manufactured by Ishihada Industries; (3) 2,4-diamino-6-trichloro-methyltriazine, common name CI-1580, manufactured by American Cyanamid; (4) Dicyandiamide, common name DCD, manufactured by Showa Denko; (5) Thiourea, common name TU, manufactured by Nitto Ryuso; (6) 1-mercapto-1,2,4-triazole, common name MT, manufactured by Nippon; (7) 2-amino-4-chloro-6-methyl-pyramidine, common name AM, manufactured by Mitsui Toatsu; (8) 3,4-dimethylpyrazole phosphate (DMPP), from BASF; (9) 1-amide-2-thiourea (ASU), from Nitto Chemical Ind.; (10) Ammoniumthiosul-phate (ATS); (11) 1H-1,2,4-triazole (HPLC); (12) 5-ethylene oxide-3-trichloro-methly 1,2,4-thiodiazole (Terrazole), from Olin Mathieson; (13) 3-methylpyrazole (3-MP); (14) 1-car-bamoyle-3-methyl-pyrazole (CMP); (15) Neem; and (16) DMPP.

Urease inhibitor that may be used herein entails: A substance that inhibits hydrolytic action on urea by the enzyme urease. Thousands of chemicals have been evalu-ated as soil urease inhibitors (Kiss and Simihaian, 2002). However, only a few of the many compounds tested meet the necessary requirements of being non toxic, effective at low concentration, stable, and compatible with urea (solid and solutions), degradable in the soil and inexpensive. They can be classified according to their structures and their assumed interaction with the enzyme urease (Watson, 2000, 2005). Four main classes of urease inhibitors have been proposed: (a) reagents which interact with the sulphydryl groups (sulphydryl reagents), (b) hydroxamates, (c) agricultural crop protection chemicals, and (d) structural analogues of urea and related compounds. N-(n-Butyl) thiophosphoric triamide (NBPT), phenylphosphorodiamidate (PPD/PPDA), and hydroquinone are probably the most thoroughly studied urease inhibitors (Kiss and Simihaian, 2002). Research and practical testing has also been carried out with N-(2-nitro-phenyl) phosphoric acid triamide (2-NPT) and ammonium thiosulphate (ATS). The organo-phosphorus compounds are structural analogues of urea and are some of the most effective inhibitors of urease activity, blocking the active site of the enzyme (Watson, 2005).

Insecticidal Seed Treatments (ISTs) for Corn

Corn seed treatments normally target three spectrums of pests: nematodes, fungal seedling diseases, and insects.

Insecticide seed treatments are usually the main compo-nent of a seed treatment package. Most corn seed available today comes with a base package that includes a fungicide and insecticide. In some aspects, the insecticide options for seed treatments include PONCHO (clothianidin), CRUISER/CRUISER EXTREME (thiamethoxam) and GAUCHO (Imidacloprid). All three of these products are neonicotinoid chemistries. CRUISER and PONCHO at the 250 (0.25 mg AI/seed) rate are some of the most common base options available for corn. In some aspects, the insec-ticide options for treatments include CRUISER 250 thiame-thoxam, CRUISER 250 (thiamethoxam) plus LUMIVIA (chlorantraniliprole), CRUISER 500 (thiamethoxam), and PONCHO VOTIVO 1250 (Clothianidin & *Bacillus firmus* I-1582).

Pioneer's base insecticide seed treatment package con-sists of CRUISER 250 with PONCHO/VOTIVO 1250 also available. VOTIVO is a biological agent that protects against nematodes.

Monsanto's products including corn, soybeans, and cot-ton fall under the ACCELERON treatment umbrella. Dekalb corn seed comes standard with PONCHO 250. Producers also have the option to upgrade to PONCHO/VOTIVO, with PONCHO applied at the 500 rate.

Agrisure, Golden Harvest and Garst have a base package with a fungicide and CRUISER 250. AVICTA complete corn is also available; this includes CRUISER 500, fungicide, and nematode protection. CRUISER EXTREME is another option available as a seed treatment package, however; the amounts of CRUISER are the same as the conventional CRUISER seed treatment, i.e. 250, 500, or 1250.

Another option is to buy the minimum insecticide treat-ment available, and have a dealer treat the seed downstream.

Commercially available ISTs for corn are listed in the below Table 13 and can be combined with one or more of the microbes taught herein.

TABLE 13

| List of exemplary seed treatments, including ISTs, which can be combined with microbes of the disclosure | | | |
|---|---|---|---|
| Treatment Type | Active Ingredient(s) | Product Trade Name | Crop |
| F | azoxystrobin | DYNASTY | Corn, Soybean |
| | | PROTÉGÉ FL | Corn |
| F | *Bacillus pumilus* | YIELD SHIELD | Corn, Soybean |
| F | *Bacillus subtilis* | HISTICK N/T | Soybean |
| | | VAULT HP | Corn, Soybean |
| F | Captan | CAPTAN 400 | Corn, Soybean |
| | | CAPTAN 400-C | Corny Soybean |
| F | Fludioxonil | MAXIM 4FS | Corn, Soybean |
| F | Hydrogen peroxide | OXIDATE | Soybean |
| | | STOROX | Soybean |
| F | ipconazole | ACCELERON DC-509 | Corn |
| | | RANCONA 3.8 FS | Corn, Soybean |
| | | VORTEX | Corn |
| F | mancozeb | BONIDE MANCOZEB w/Zinc Concentrate | Corn |
| | | DITHANE 75DF RAINSHIELD | Corn |
| | | DITHANE DF RAINSHIELD | Corn |
| | | DITHANE F45 RAINSHIELD | Corn |

TABLE 13-continued

List of exemplary seed treatments, including ISTs, which
can be combined with microbes of the disclosure

| Treatment Type | Active Ingredient(s) | Product Trade Name | Crop |
|---|---|---|---|
| | | DITHANE M45 | Corn |
| | | LESCO 4 FLOWABLE MANCOZEB | Corn |
| | | PENNCOZEB 4FL FLOWABLE | Corn |
| | | PENNCOZEB 75DF DRY FLOWABLE | Corn |
| | | PENNCOZEB 80WP | Corn |
| F | mefenoxam | APRON XL | Corn, Soybean |
| F | metalaxyl | ACCELERON DC-309 | Corn |
| | | ACCELERON DX-309 | Corn, Soybean |
| | | ACQUIRE | Corn, Soybean |
| | | AGRI STAR METALAXYL 265 ST | Corn, Soybean |
| | | ALLEGIANCE DRY | Corn, Soybean |
| | | ALLEGIANCE FL | Corn, Soybean |
| | | BELMONT 2.7 FS | Corn, Soybean |
| | | DYNA-SHIELD METALAXYL | Corn, Soybean |
| | | SEBRING 2.65 ST | Corn, Soybean |
| | | SEBRING 318 FS | Corn, Soybean |
| | | SEBRING 480 FS | Corn, Soybean |
| | | VIREO MEC | Soybean |
| F | pyraclostrobin | ACCELERON DX-109 | Soybean |
| | | STAMINA | Corn |
| F | *Streptomyces griseoviridis* | MYCOSTOP | Corn, Soybean |
| F | *Streptomyces lydicus* | ACTINOGROW ST | Corn, Soybean |
| F | tebuconazole | AMTIDE TEBU 3.6F | Corn |
| | | SATIVA 309 FS | Corn |
| | | SATIVA 318 FS | Corn |
| | | TEBUSHA 3.6FL | Corn |
| | | TEBUZOL 3.6F | Corn |
| F | thiabendazole | MERTECT 340-F | Soybean |
| F | thiram | 42-S THIRAM | Corn, Soybean |
| | | FLOWSAN | Corn, Soybean |
| | | SIGNET 480 FS | Corn, Soybean |
| F | *Trichoderma harzianum* Rifai | T-22 HC | Corn, Soybean |
| F | trifloxystrobin | ACCELERON DX-709 | Corn |
| | | TRILEX FLOWABLE | Corn, soybean |
| I | chlorpyrifos | LORSBAN 50W in water soluble packets | Corn |
| I | clothianidin | ACCELERON IC-609 | Corn |
| | | NIPSIT INSIDE | Corn, Soybean |
| | | PONCHO 600 | Corn |
| I | imidacloprid | ACCELERON IX-409 | Corn |
| | | AGRI STAR MACHO 600 ST | Corn, Soybean |
| | | AGRISOLUTIONS NITRO SHIELD | Corn, Soybean |
| | | ATTENDANT 600 | Corn, Soybean |
| | | AXCESS | Corn, Soybean |
| | | COURAZE 2F | Soybean |
| | | DYNA-SHIELD IMIDACLOPRID 5 | Corn, Soybean |
| | | GAUCHO 480 FLOWABLE | Corn, Soybean |
| | | GAUCHO 600 FLOWABLE | Corn, Soybean |
| | | GAUCHO SB FLOWABLE | Corn, Soybean |
| | | NUPRID 4.6F PRO | Soybean |
| | | SENATOR 600 FS | Corn, Soybean |
| I | thiamethoxam | CRUISER 5FS | Corn, Soybean |
| N | abamectin | AVICTA 500 FS | Corn, Soybean |
| N | *Bacillus firmus* | VOTIVO FS | Soybean |
| P | cytokinin | SOIL X-CYTO | Soybean |
| | | X-CYTE | Soybean |
| P | harpin alpha beta protein | ACCELERON HX-209 | Corn, Soybean |
| | | N-HIBIT GOLD CST | Corn, Soybean |
| | | N-HIBIT HX-209 | Corn, Soybean |
| P | indole butyric acid | KICKSTAND PGR | Corn, Soybean |
| I, N | thiamethoxam, abamectin | AVICTA DUO CORN | Corn |
| | | AVICTA DUO 250 | |
| I, F | clothianidin, *Bacillus firmus* | PONCHO VOTIVO | Corn, Soybean |
| F, F | carboxin, captan | ENHANCE | Soybean |
| I, F | permethrin, carboxin | KERNEL GUARD SUPREME | Corn, Soybean |
| F, F | carboxin, thiram | VITAFLO 280 | Corn, Soybean |

TABLE 13-continued

List of exemplary seed treatments, including ISTs, which
can be combined with microbes of the disclosure

| Treatment Type | Active Ingredient(s) | Product Trade Name | Crop |
|---|---|---|---|
| F, F | mefenoxam, fludioxonil | MAXIM XL<br>WARDEN RTA<br>APRON MAXX RFC<br>APRON MAXX RTA + MOLY<br>APRON MAXX RTA | Corn, Soybean<br>Soybean |
| I, F | imidacloprid, metalaxyl | AGRISOLUTIONS CONCUR | Corn |
| F, F | metalaxyl, ipconazole | RANCONA SUMMIT<br>RANCONA XXTRA | Soybean |
| F, F | thiram, metalaxyl | PROTECTOR-L-ALLEGIANCE | Soybean |
| F, F | trifloxystrobin,<br>metalaxyl | TRILEX AL<br>TRILEX 2000 | Soybean |
| P, P, P | cytokinin, gibberellic<br>acid, indole butyric acid | STIMULATE YIELD<br>ENHANCER ASCEND | Corn, Soybean |
| F, F, I | mefenoxam,<br>fludioxonil,<br>thiamethoxam | CRUISERMAXX PLUS | Soybean |
| F, F, F | captan, carboxin,<br>metalaxyl | BEAN GUARD/ALLEGIANCE | Soybean |
| F, F, I | captan, carboxin,<br>imidacloprid | ENHANCE AW | Soybean |
| F, F, I | carboxin,<br>metalaxyl, imidacloprid | LATITUDE | Corn, Soybean |
| F, F, F | metalaxyl,<br>pyraclostrobin,<br>triticonazole | STAMINA F3 HL | Corn |
| F, F, F, I | azoxystrobin,<br>fludioxonil,<br>mefenoxam,<br>thiamethoxam | CRUISER EXTREME | Corn |
| F, F, F, F, F | azoxystrobin,<br>fludioxonil,<br>mefenoxam,<br>thiabendazole | MAXIM QUATTRO | Corn |
| I | Chlorantraniliprole | LUMIVIA | Corn |

F = Fungicide;
I = Insecticide;
N = Nematicide;
P = Plant Growth Regulator

Application of Bacterial Populations on Crops

The composition of the bacteria or bacterial population described herein can be applied in furrow, in talc, or as seed treatment. The composition can be applied to a seed package in bulk, mini bulk, in a bag, or in talc.

The planter can plant the treated seed and grows the crop according to conventional ways, twin row, or ways that do not require tilling. The seeds can be distributed using a control hopper or an individual hopper. Seeds can also be distributed using pressurized air or manually. Seed placement can be performed using variable rate technologies. Additionally, application of the bacteria or bacterial population described herein may be applied using variable rate technologies. In some examples, the bacteria can be applied to seeds of corn, soybean, canola, *sorghum*, potato, rice, vegetables, cereals, pseudocereals, and oilseeds. Examples of cereals may include barley, fonio, oats, palmer's grass, rye, pearl millet, *sorghum*, spelt, teff, triticale, and wheat. Examples of pseudocereals may include breadnut, buckwheat, cattail, chia, flax, grain amaranth, hanza, *quinoa*, and sesame. In some examples, seeds can be genetically modified organisms (GMO), non-GMO, organic or conventional.

Additives such as micro-fertilizer, PGR, herbicide, insecticide, and fungicide can be used additionally to treat the crops. Examples of additives include crop protectants such as insecticides, nematicides, fungicide, enhancement agents such as colorants, polymers, pelleting, priming, and disinfectants, and other agents such as inoculant, PGR, softener, and micronutrients. PGRs can be natural or synthetic plant hormones that affect root growth, flowering, or stem elongation. PGRs can include auxins, gibberellins, cytokinins, ethylene, and abscisic acid (ABA).

The composition can be applied in furrow in combination with liquid fertilizer. In some examples, the liquid fertilizer may be held in tanks. NPK fertilizers contain macronutrients of sodium, phosphorous, and potassium.

The composition may improve plant traits, such as promoting plant growth, maintaining high chlorophyll content in leaves, increasing fruit or seed numbers, and increasing fruit or seed unit weight. Methods of the present disclosure may be employed to introduce or improve one or more of a variety of desirable traits. Examples of traits that may introduced or improved include: root biomass, root length, height, shoot length, leaf number, water use efficiency, overall biomass, yield, fruit size, grain size, photosynthesis rate, tolerance to drought, heat tolerance, salt tolerance, tolerance to low nitrogen stress, nitrogen use efficiency, resistance to nematode stress, resistance to a fungal pathogen, resistance to a bacterial pathogen, resistance to a viral pathogen, level of a metabolite, modulation in level of a metabolite, proteome expression. The desirable traits, including height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof, can be used to measure growth, and compared with the growth rate of reference agricultural plants (e.g., plants without the introduced and/or improved traits) grown under identical conditions. In some examples, the desirable traits, including height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof, can be used to measure growth, and compared with the growth rate of reference agricultural plants (e.g., plants without the introduced and/or improved traits) grown under similar conditions.

An agronomic trait to a host plant may include, but is not limited to, the following: altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, and a detectable modulation in the proteome, compared to an isoline plant grown from a seed without said seed treatment formulation.

In some cases, plants are inoculated with bacteria or bacterial populations that are isolated from the same species of plant as the plant element of the inoculated plant. For example, an bacteria or bacterial population that is normally found in one variety of *Zea mays* (corn) is associated with a plant element of a plant of another variety of *Zea mays* that in its natural state lacks said bacteria and bacterial populations. In one embodiment, the bacteria and bacterial populations is derived from a plant of a related species of plant as the plant element of the inoculated plant. For example, an bacteria and bacterial populations that is normally found in *Zea diploperennis* Iltis et al., (diploperennial teosinte) is applied to a *Zea mays* (corn), or vice versa. In some cases, plants are inoculated with bacteria and bacterial populations that are heterologous to the plant element of the inoculated plant. In one embodiment, the bacteria and bacterial populations is derived from a plant of another species. For example, an bacteria and bacterial populations that is normally found in dicots is applied to a monocot plant (e.g., inoculating corn with a soybean-derived bacteria and bacterial populations), or vice versa. In other cases, the bacteria and bacterial populations to be inoculated onto a plant is derived from a related species of the plant that is being inoculated. In one embodiment, the bacteria and bacterial populations is derived from a related taxon, for example, from a related species. The plant of another species can be an agricultural plant. In another embodiment, the bacteria and bacterial populations is part of a designed composition inoculated into any host plant element.

In some examples, the bacteria or bacterial population is exogenous wherein the bacteria and bacterial population is isolated from a different plant than the inoculated plant. For example, in one embodiment, the bacteria or bacterial population can be isolated from a different plant of the same species as the inoculated plant. In some cases, the bacteria or bacterial population can be isolated from a species related to the inoculated plant.

In some examples, the bacteria and bacterial populations described herein are capable of moving from one tissue type to another. For example, the present disclosure's detection and isolation of bacteria and bacterial populations within the mature tissues of plants after coating on the exterior of a seed demonstrates their ability to move from seed exterior into the vegetative tissues of a maturing plant. Therefore, in one embodiment, the population of bacteria and bacterial populations is capable of moving from the seed exterior into the vegetative tissues of a plant. In one embodiment, the bacteria and bacterial populations that is coated onto the seed of a plant is capable, upon germination of the seed into a vegetative state, of localizing to a different tissue of the plant. For example, bacteria and bacterial populations can be capable of localizing to any one of the tissues in the plant, including: the root, adventitious root, seminal 5 root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In one embodiment, the bacteria and bacterial populations is capable of localizing to the root and/or the root hair of the plant. In another embodiment, the bacteria and bacterial populations is capable of localizing to the photosynthetic tissues, for example, leaves and shoots of the plant. In other cases, the bacteria and bacterial populations is localized to the vascular tissues of the plant, for example, in the xylem and phloem. In still another embodiment, the bacteria and bacterial populations is capable of localizing to the reproductive tissues (flower, pollen, pistil, ovaries, stamen, fruit) of the plant. In another embodiment, the bacteria and bacterial populations is capable of localizing to the root, shoots, leaves and reproductive tissues of the plant. In still another embodiment, the bacteria and bacterial populations colonizes a fruit or seed tissue of the plant. In still another embodiment, the bacteria and bacterial populations is able to colonize the plant such that it is present in the surface of the plant (i.e., its presence is detectably present on the plant exterior, or the episphere of the plant). In still other embodiments, the bacteria and bacterial populations is capable of localizing to substantially all, or all, tissues of the plant. In certain embodiments, the bacteria and bacterial populations is not localized to the root of a plant. In other cases, the bacteria and bacterial populations is not localized to the photosynthetic tissues of the plant.

The effectiveness of the compositions can also be assessed by measuring the relative maturity of the crop or the crop heating unit (CHU). For example, the bacterial population can be applied to corn, and corn growth can be assessed according to the relative maturity of the corn kernel or the time at which the corn kernel is at maximum weight. The crop heating unit (CHU) can also be used to predict the maturation of the corn crop. The CHU determines the amount of heat accumulation by measuring the daily maximum temperatures on crop growth.

In examples, bacterial may localize to any one of the tissues in the plant, including: the root, adventitious root, seminal root, root hair, shoot, leaf, flower, bud tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In another embodiment, the bacteria or bacterial population is capable of localizing to the photosynthetic tissues, for example, leaves and shoots of the plant. In other cases, the bacteria and bacterial populations is localized to the vascular tissues of the plant, for example, in the xylem and phloem. In another embodiment, the bacteria or bacterial population is capable of localizing to reproductive tissues (flower, pollen, pistil, ovaries, stamen, or fruit) of the plant. In another embodiment, the bacteria and bacterial populations is capable of localizing to the root, shoots, leaves and reproductive tissues of the plant. In another embodiment, the bacteria or bacterial population colonizes a fruit or seed tissue of the plant. In still another embodiment, the bacteria or bacterial population is able to colonize the plant such that it is present in the surface of the plant. In another embodiment, the bacteria or bacterial population is capable of localizing to substantially all, or all, tissues of the plant. In certain embodiments, the bacteria or bacterial population is not localized to the root of a plant. In other cases, the bacteria and bacterial populations is not localized to the photosynthetic tissues of the plant.

The effectiveness of the bacterial compositions applied to crops can be assessed by measuring various features of crop growth including, but not limited to, planting rate, seeding vigor, root strength, drought tolerance, plant height, dry down, and test weight.

Plant Species

The methods and bacteria described herein are suitable for any of a variety of plants, such as plants in the genera *Hordeum*, *Oryza*, *Zea*, and *Triticeae*. Other non-limiting examples of suitable plants include mosses, lichens, and algae. In some cases, the plants have economic, social and/or environmental value, such as food crops, fiber crops, oil crops, plants in the forestry or pulp and paper industries, feedstock for biofuel production and/or ornamental plants. In some examples, plants may be used to produce economically valuable products such as a grain, a flour, a starch, a syrup, a meal, an oil, a film, a packaging, a nutraceutical product, a pulp, an animal feed, a fish fodder, a bulk material for industrial chemicals, a cereal product, a processed human-food product, a sugar, an alcohol, and/or a protein. Non-limiting examples of crop plants include maize, rice, wheat, barley, *sorghum*, millet, oats, rye triticale, buckwheat, sweet corn, sugar cane, onions, tomatoes, strawberries, and asparagus. In some embodiments, the methods and bacteria described herein are suitable for any of a variety of transgenic plants, non-transgenic plants, and hybrid plants thereof.

In some examples, plants that may be obtained or improved using the methods and composition disclosed herein may include plants that are important or interesting for agriculture, horticulture, biomass for the production of biofuel molecules and other chemicals, and/or forestry. Some examples of these plants may include pineapple, banana, coconut, lily, grasspeas and grass; and dicotyledonous plants, such as, for example, peas, alfalfa, tomatillo, melon, chickpea, chicory, clover, kale, lentil, soybean, tobacco, potato, sweet potato, radish, cabbage, rape, apple trees, grape, cotton, sunflower, thale cress, canola, citrus (including orange, mandarin, kumquat, lemon, lime, grapefruit, tangerine, tangelo, citron, and pomelo), pepper, bean, lettuce, *Panicum virgatum* (switch), *Sorghum bicolor* (*sorghum*, sudan), *Miscanthus giganteus* (*miscanthus*), *Saccha-*

*rum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), *Pennisetum glaucum* (pearl millet), *Panicum* spp. *Sorghum* spp., *Miscanthus* spp., *Saccharum* spp., *Erianthus* spp., *Populus* spp., *Secale cereale* (rye), *Salix* spp. (willow), *Eucalyptus* spp. (*eucalyptus*), Triticosecale spp. (*triticum*-25 wheat X rye), Bamboo, *Carthamus tinctorius* (safflower), *Jatropha curcas* (*Jatropha*), *Ricinus communis* (castor), *Elaeis guineensis* (oil palm), *Phoenix dactylifera* (date palm), *Archontophoenix cunninghamiana* (king palm), *Syagrus romanzoffiana* (queen palm), *Linum usitatissimum* (flax), *Brassica juncea, Manihot esculenta* (cassaya), *Lycopersicon esculentum* (tomato), *Lactuca saliva* (lettuce), *Musa paradisiaca* (banana), *Solanum tuberosum* (potato), *Brassica oleracea* (broccoli, cauliflower, brussel sprouts), *Camellia sinensis* (tea), Fragaria *ananassa* (strawberry), *Theobroma cacao* (cocoa), *Coffea arabica* (coffee), *Vitis vinifera* (grape), *Ananas comosus* (pineapple), *Capsicum* annum (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), *Solanum melongena* (eggplant), *Papaver somniferum* (opium poppy), *Papaver orientale, Taxus baccata, Taxus brevifolia, Artemisia annua, Cannabis* saliva, *Camptotheca acuminate, Catharanthus roseus, Vinca rosea, Cinchona officinalis, Coichicum autumnale, Veratrum californica, Digitalis lanata, Digitalis purpurea, Dioscorea 5 spp., Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum (Huperzia serrata), Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii, Tanacetum parthenium, Parthenium argentatum* (guayule), *Hevea* spp. (rubber), *Mentha spicata* (mint), *Mentha piperita* (mint), *Bixa orellana, Alstroemeria* spp., *Rosa* spp. (rose), *Dianthus caryophyllus* (carnation), *Petunia* spp. (*petunia*), *Poinsettia pulcherrima* (poinsettia), *Nicotiana tabacum* (tobacco), *Lupinus albus* (lupin), *Uniola paniculata* (oats), *Hordeum vulgare* (barley), and *Lolium* spp. (rye).

In some examples, a monocotyledonous plant may be used. Monocotyledonous plants belong to the orders of the Alismatales, Arales, Arecales, Bromeliales, Commelinales, Cyclanthales, Cyperales, Eriocaulales, Hydrocharitales, Juncales, Lilliales, Najadales, Orchidales, Pandanales, Poales, Restionales, Triuridales, Typhales, and Zingiberales. Plants belonging to the class of the Gymnospermae are Cycadales, Ginkgoales, Gnetales, and Pinales. In some examples, the monocotyledonous plant can be selected from the group consisting of a maize, rice, wheat, barley, and sugarcane.

In some examples, a dicotyledonous plant may be used, including those belonging to the orders of the Aristochiales, Asterales, Batales, Campanulales, Capparales, Caryophyllales, Casuarinales, Celastrales, Cornales, Diapensales, Dilleniales, Dipsacales, Ebenales, Ericales, Eucomiales, Euphorbiales, Fabales, Fagales, Gentianales, Geraniales, Haloragales, Hamamelidales, Middles, Juglandales, Lamiales, Laurales, Lecythidales, Leitneriales, Magniolales, Malvales, Myricales, Myrtales, Nymphaeales, Papeverales, Piperales, Plantaginales, Plumb aginales, Podostemales, Polemoniales, Polygalales, Polygonales, Primulales, Proteales, Rafflesiales, Ranunculales, Rhamnales, Rosales, Rubiales, Salicales, Santales, Sapindales, Sarraceniaceae, Scrophulariales, Theales, Trochodendrales, Umbellales, Urticales, and Violates. In some examples, the dicotyledonous plant can be selected from the group consisting of cotton, soybean, pepper, and tomato.

In some cases, the plant to be improved is not readily amenable to experimental conditions. For example, a crop plant may take too long to grow enough to practically assess an improved trait serially over multiple iterations. Accordingly, a first plant from which bacteria are initially isolated, and/or the plurality of plants to which genetically manipulated bacteria are applied may be a model plant, such as a plant more amenable to evaluation under desired conditions. Non-limiting examples of model plants include *Setaria*, Brachypodium, and *Arabidopsis*. Ability of bacteria isolated according to a method of the disclosure using a model plant may then be applied to a plant of another type (e.g. a crop plant) to confirm conferral of the improved trait.

Traits that may be improved by the methods disclosed herein include any observable characteristic of the plant, including, for example, growth rate, height, weight, color, taste, smell, changes in the production of one or more compounds by the plant (including for example, metabolites, proteins, drugs, carbohydrates, oils, and any other compounds). Selecting plants based on genotypic information is also envisaged (for example, including the pattern of plant gene expression in response to the bacteria, or identifying the presence of genetic markers, such as those associated with increased nitrogen fixation). Plants may also be selected based on the absence, suppression or inhibition of a certain feature or trait (such as an undesirable feature or trait) as opposed to the presence of a certain feature or trait (such as a desirable feature or trait).

Non-Genetically Modified Maize

The methods and bacteria described herein are suitable for any of a variety of non-genetically modified maize plants or part thereof. And in some aspects the corn is organic. Furthermore, the methods and bacteria described herein are suitable for any of the following non-genetically modified hybrids, varieties, lineages, etc. In some embodiments, corn varieties generally fall under six categories: sweet corn, flint corn, popcorn, dent corn, pod corn, and flour corn.

Sweet Corn

Yellow su varieties include Earlivee, Early Sunglow, Sundance, Early Golden Bantam, Iochief, Merit, Jubilee, and Golden Cross Bantam. White su varieties include True Platinum, Country Gentleman, Silver Queen, and Stowell's Evergreen. Bicolor su varieties include Sugar & Gold, Quickie, Double Standard, Butter & Sugar, Sugar Dots, Honey & Cream. Multicolor su varieties include Hookers, Triple Play, Painted Hill, Black Mexican/Aztec.

Yellow se varieties include Buttergold, Precocious, Spring Treat, Sugar Buns, Colorow, Kandy King, Bodacious R/M, Tuxedo, Incredible, Merlin, Miracle, and Kandy Korn E H. White se varieties include Spring Snow, Sugar Pearl, Whiteout, Cloud Nine, Alpine, Silver King, and Argent. Bicolor se varieties include Sugar Baby, Fleet, Bon Jour, Trinity, Bi-Licious, Temptation, Luscious, *Ambrosia*, Accord, Brocade, Lancelot, Precious Gem, Peaches and Cream Mid EH, and Delectable R/M. Multicolor se varieties include Ruby Queen.

Yellow sh2 varieties include Extra Early Super Sweet, Takeoff, Early Xtra Sweet, Raveline, Summer Sweet Yellow, Krispy King, Garrison, Illini Gold, Challenger, Passion, Excel, Jubilee SuperSweet, Illini Xtra Sweet, and Crisp 'N Sweet. White sh2 varieties include Summer Sweet White, Tahoe, Aspen, Treasure, How Sweet It Is, and Camelot. Bicolor sh2 varieties include Summer Sweet Bicolor, Radiance, Honey 'N Pearl, Aloha, Dazzle, Hudson, and Phenomenal.

Yellow sy varieties include Applause, Inferno, Honeytreat, and Honey Select. White sy varieties include Silver Duchess, *Cinderella*, Mattapoisett, Avalon, and Captivate. Bicolor sy varieties include Pay Dirt, Revelation, Renaissance, *Charisma*, Synergy, Montauk, Kristine, Serendipity/Providence, and Cameo.

Yellow augmented supersweet varieties include Xtra-Tender 1ddA, Xtra-Tender 11dd, Mirai 131Y, Mirai 130Y, Vision, and Mirai 002. White augmented supersweet varieties include Xtra-Tender 3dda, Xtra-Tender 31dd, Mirai 421W, XTH 3673, and Devotion. Bicolor augmented supersweet varieties include Xtra-Tender 2dda, Xtra-Tender 21dd, Kickoff XR, Mirai 308BC, Anthem XR, Mirai 336BC, Fantastic XR, Triumph, Mirai 301BC, Stellar, American Dream, Mirai 350BC, and Obsession.

Flint Corn

Flint corn varieties include Bronze-Orange, Candy Red Flint, Floriani Red Flint, Glass Gem, Indian Ornamental (Rainbow), Mandan Red Flour, Painted Mountain, Petmecky, Cherokee White Flour, PopCorn Pop corn varieties include Monarch Butterfly, Yellow Butterfly, Midnight Blue, Ruby Red, Mixed Baby Rice, Queen Mauve, Mushroom Flake, Japanese Hull-less, Strawberry, Blue Shaman, Miniature Colored, Miniature Pink, Pennsylvania Dutch Butter Flavor, and Red Strawberry.

Dent Corn

Dent corn varieties include Bloody Butcher, Blue Clarage, Ohio Blue Clarage, Cherokee White Eagle, Hickory Cane, Hickory King, Jellicorse Twin, Kentucky Rainbow, Daymon Morgan's Knt. Butcher, Leaming, Leaming's Yellow, McCormack's Blue Giant, Neal Paymaster, Pungo Creek Butcher, Reid's Yellow Dent, Rotten Clarage, and Tennessee Red Cob.

In some embodiments, corn varieties include P1618W, P1306W, P1345, P1151, P1197, P0574, P0589, and P0157. W=white corn.

In some embodiments, the methods and bacteria described herein are suitable for any hybrid of the maize varieties setforth herein.

Genetically Modified Maize

The methods and bacteria described herein are suitable for any of a hybrid, variety, lineage, etc. of genetically modified maize plants or part thereof.

Furthermore, the methods and bacteria described herein are suitable for any of the following genetically modified maize events, which have been approved in one or more countries: 32138 (32138 SPT Maintainer), 3272 (ENOGEN), 3272×Bt11, 3272×bt11×GA21, 3272×Bt11×MIR604, 3272×Bt11×MIR604×GA21, 3272×Bt11×MIR604×TC1507×5307×GA21, 3272×GA21, 3272×MIR604, 3272×MIR604×GA21, 4114, 5307 (AGRISURE Duracade), 5307×GA21, 5307×MIR604×Bt11×TC1507×GA21 (AGRISURE Duracade 5122), 5307×MIR604×Bt11×TC1507×GA21×MIR162 (AGRISURE Duracade 5222), 59122 (HERCULEX RW), 59122×DAS40278, 59122×GA21, 59122×MIR604, 59122×MIR604×GA21, 59122×MIR604×TC1507, 59122×MIR604×TC1507×GA21, 59122×MON810, 59122×MON810×MIR604, 59122×MON810×NK603, 59122×MON810×NK603×MIR604, 59122×MON88017, 59122×MON88017×DAS40278, 59122×NK603 (Herculex RW ROUNDUP READY 2), 59122×NK603×MIR604, 59122×TC1507×GA21, 676, 678, 680, 3751 IR, 98140, 98140×59122, 98140×TC1507, 98140×TC1507×59122, Bt10 (Bt10), Bt11 [×4334CBR, X4734CBR] (AGRISURE CB/LL), Bt11×5307, Bt11× 5307×GA21, Bt11×59122×MIR604, Bt11×59122× MIR604×GA21, Bt11×59122×MIR604×TC1507, M53, M56, DAS-59122-7, Bt11×59122×MIR604×TC1507× GA21, Bt11×59122×TC1507, TC1507×DAS-59122-7, Bt11×59122×TC1507×GA21, Bt11×GA21 (AGRISURE GT/CB/LL), Bt11×MIR162 (AGRISURE Viptera 2100), BT11×MIR162×5307, Bt11×MIR162×5307×GA21, Bt11× MIR162×GA21 (AGRISURE Viptera 3110), Bt11× MIR162×MIR604 (AGRISURE Viptera 3100), Bt11× MIR162×MIR604×5307, Bt11×MIR162×MIR604×5307× GA21, Bt11×MIR162×MIR604×GA21 (AGRISURE Viptera 3111/AGRISURE Viptera 4), Bt11, MIR162× MIR604×MON89034×5307×GA21, Bt11×MIR162× MIR604×TC1507, Bt11×MIR162×MIR604×TC1507× 5307, Bt11×MIR162×MIR604×TC1507×GA21, Bt11× MIR162×MON89034, Bt11×MIR162×MON89034×GA21, Bt11×MIR162×TC1507, Bt11×MIR162×TC1507×5307, Bt11×MIR162×TC1507×5307×GA21, Bt11×MR162× TC1507×GA21 (AGRISURE Viptera 3220), BT11× MIR604 (Agrisure BC/LL/RW), Bt11×MIR604×5307, Bt11×MIR604×5307×GA21, Bt11×MIR604×GA21, Bt11× MIR604×TC1507, Bt11×MIR604×TC1507×5307, Bt11× MIR604×TC1507×GA21, Bt11×MON89Ø34×GA21, Bt11×TC1507, Bt11×TC1507×5307, Bt11×TC1507×GA21, Bt176 [176] (NaturGard KnockOut/Maximizer), BVLA430101, CBH-351 (STARLINK Maize), DAS40278 (ENLIST Maize), DAS40278×NK603, DBT418 (Bt Xtra Maize), DLL25 [B16], GA21 (ROUNDUP READY Maize/ AGRISURE GT), GA21×MON810 (ROUNDUP READY Yieldgard Maize), GA21×T25, HCEM485, LY038 (MA-VERA Maize), LY038×MON810 (MAVERA Yieldgard Maize), MIR162 (AGRISURE Viptera), MIR162×5307, MIR162×5307×GA21, MIR162×GA21, MIR162×MIR604, MIR162×MIR604×5307, MIR162×MIR604×5307×GA21, MIR162×MIR604×GA21, MIR162×MIR604×TC1507× 5307, MIR162×MIR604×TC1507×5307×GA21, MIR162× MIR604×TC1507×GA21, MIR162×MON89034, MIR162× NK603, MIR162×TC1507, MIR162×TC1507×5307, MIR162×TC1507×5307×GA21, MIR162×TC1507×GA21, MIR604 (AGRISURE RW), MIR604×5307, MIR604× 5307×GA21, MIR604×GA21 (AGRISURE GT/RW), MIR604×NK603, MIR604×TC1507, MIR604×TC1507× 5307, MIR604×TC1507×5307 ×GA21, MIR604×TC1507× GA21, MON801 [MON80100], MON802, MON809, MON810 (YIELDGARD, MAIZEGARD), MON810× MIR162, MON810×MIR162×NK603, MON810×MIR604, MON810×MON88017 (YIELDGARD VT Triple), MON810×NK603×MIR604, MON832 (ROUNDUP READY Maize), MON863 (YIELDGARD Rootworm RW, MAXGARD), MON863×MON810 (YIELDGARD Plus), MON863×MON810×NK603 (YIELDGARD Plus with RR), MON863×NK603 (YIELDGARD RW+RR), MON87403, MON87411, MON87419, MON87427 (ROUNDUP READY Maize), MON87427×59122, MON87427×MON88017, MON87427×MON88017× 59122, MON87427×MON89034, MON87427× MON89034×59122, MON87427×MON89034×MIR162× MON87411, MON87427×MON89034×MON88017, MON87427×MON89034×MON88017×59122, MON87427×MON89034×NK603, MON87427× MON89034×TC1507, MON87427×MON89034×TC1507× 59122, MON87427×MON89034×TC1507×MON87411× 59122, MON87427×MON89034×TC1507×MON87411× 59122×DAS40278, MON87427×MON89034×TC1507×

MON88017, MON87427×MON89034×MIR162×NK603, MON87427×MON89034×TC1507×MON88017×59122, MON87427×TC1507, MON87427×TC1507×59122, MON87427×TC1507×MON88017, MON87427×TC1507× MON88017×59122, MON87460 (GENUITY DROUGHT-GARD), MON87460×MON88017, MON87460× MON89034×MON88017, MON87460×MON89034× NK603, MON87460×NK603, MON88017, MON88017× DAS40278, MON89034, MON89034×59122, MON89034× 59122×DAS40278, MON89034×59122×MON88017, MON89034×59122×MON88017×DAS40278, MON89034×DAS40278, MON89034×MON87460, MON89034×MON88017 (GENUITY VT Triple Pro), MON89034×MON88017×DAS40278, MON89034× NK603 (GENUITY VT Double Pro), MON89034×NK603× DAS40278, MON89034×TC1507, MON89034×TC1507× 59122, MON89034×TC1507×59122×DAS40278, MON89034×TC1507×DAS40278, MON89034×TC1507× MON88017, MON89034×TC1507×MON88017×59122 (GENUITY SMARTSTAX), MON89034×TC1507× MON88017×59122×DAS40278, MON89034×TC1507× MON88017×DAS40278, MON89034×TC1507×NK603 (POWER CORE), MON89034×TC1507×NK603× DAS40278, MON89034×TC1507×NK603×MIR162, MON89034×TC1507×NK603×MIR162×DAS40278, MON89034×GA21, MS3 (INVIGOR Maize), MS6 (IN-VIGOR Maize), MZHGOJG, MZIR098, NK603 (ROUNDUP READY 2 Maize), NK603×MON810×4114× MIR604, NK603×MON810 (YIELDGARD CB+RR), NK603×T25 (ROUNDUP READY LIBERTY LINK Maize), T14 (LIBERTY LINK Maize), T25 (LIBERTY LINK Maize), T25×MON810 (LIBERTY LINK YIELD-GARD Maize), TC1507 (HERCULEX I, HERCULEX CB), TC1507×59122×MON810×MIR604×NK603 (OPTIMUM INTRASECT XTREME), TC1507×MON810×MIR604× NK603, TC1507×5307, TC1507×5307×GA21, TC1507× 59122 (HERCULEX XTRA), TC1507×59122×DAS40278, TC1507×59122×MON810, TC1507×59122×MON810× MIR604, TC1507×59122×MON810×NK603 (OPTIMUM INTRASECT XTRA), TC1507×59122×MON88017, TC1507×59122×MON88017×DAS40278, TC1507× 59122×NK603 (HERCULEX XTRA RR), TC1507×59122× NK603×MIR604, TC1507×DAS40278, TC1507×GA21, TC1507×MIR162×NK603, TC1507×MIR604×NK603 (OP-TIMUM TRISECT), TC1507×MON810, TC1507× MON810×MIR162, TC1507×MON810×MIR162×NK603, TC1507×MON810×MIR604, TC1507×MON810×NK603 (OPTIMUM INTRASECT), TC1507×MON810×NK603× MIR604, TC1507×MON88017, TC1507×MON88017× DAS40278, TC1507×NK603 (HERCULEX I RR), TC1507×NK603×DAS40278, TC6275, and VCO-01981-5.

Additional Genetically Modified Plants

The methods and bacteria described herein are suitable for any of a variety of genetically modified plants or part thereof.

Furthermore, the methods and bacteria described herein are suitable for any of the following genetically modified plant events which have been approved in one or more countries.

TABLE 14

Rice Traits, which can be combined with microbes of the disclosure
*Oryza sativa* Rice

| Event | Company | Description |
|---|---|---|
| CL121, CL141, CFX51 | BASF Inc. | Tolerance to the imidazolinone herbicide, imazethapyr, induced by chemical mutagenesis of the acetolactate synthase (ALS) enzyme using ethyl methanesulfonate (EMS). |
| IMINTA-1, IMINTA-4 | BASF Inc. | Tolerance to imidazolinone herbicides induced by chemical mutagenesis of the acetolactate synthase (ALS) enzyme using sodium azide. |
| LLRICE06, LLRICE62 | Aventis CropScience | Glufosinate ammonium herbicide tolerant rice produced by inserting a modified phosphinothricin acetyltransferase (PAT) encoding gene from the soil bacterium *Streptomyces hygroscopicus*). |
| LLRICE601 | Bayer CropScience (Aventis CropScience(AgrEvo)) | Glufosinate ammonium herbicide tolerant rice produced by inserting a modified phosphinothricin acetyltransferase (PAT) encoding gene from the soil bacterium *Streptomyces hygroscopicus*). |
| PWC16 | BASF Inc. | Tolerance to the imidazolinone herbicide, imazethapyr, induced by chemical mutagenesis of the acetolactate synthase (ALS) enzyme using ethyl methanesulfonate (EMS). |

TABLE 15

Alfalfa Traits, which can be combined with microbes of the disclosure
*Medicago sativa* Alfalfa

| Event | Company | Description |
|---|---|---|
| J101, J163 | Monsanto Company and Forage Genetics International | Glyphosate herbicide tolerant alfalfa (lucerne) produced by inserting a gene encoding the enzyme 5-enolypyruvylshikimate- |

TABLE 15-continued

Alfalfa Traits, which can be combined with microbes of the disclosure
*Medicago sativa* Alfalfa

| Event | Company | Description |
|---|---|---|
| | | 3-phosphate synthase (EPSPS) from the CP4 strain of *Agrobacterium tumefaciens*. |

TABLE 16

Wheat Traits, which can be combined with microbes of the disclosure
*Triticum aestivum* Wheat

| Event | Company | Description |
|---|---|---|
| AP205CL | BASF Inc. | Selection for a mutagenized version of the enzyme acetohydroxyacid synthase (AHAS), also known as acetolactate synthase (ALS) or acetolactate pyruvate-lyase. |
| AP602CL | BASF Inc. | Selection for a mutagenized version of the enzyme acetohydroxyacid synthase (AHAS), also known as acetolactate synthase (ALS) or acetolactate pyruvate-lyase. |
| BW255-2, BW238-3 | BASF Inc. | Selection for a mutagenized version of the enzyme acetohydroxyacid synthase (AHAS), also known as acetolactate synthase (ALS) or acetolactate pyruvate-lyase. |
| BW7 | BASF Inc. | Tolerance to imidazolinone herbicides induced by chemical mutagenesis of the acetohydroxyacid synthase (AHAS) gene using sodium azide. |

TABLE 16-continued

Wheat Traits, which can be combined with microbes of the disclosure
*Triticum aestivum* Wheat

| Event | Company | Description |
|---|---|---|
| MON71800 | Monsanto Company | Glyphosate tolerant wheat variety produced by inserting a modified 5-enolpyruvylshikimate-3-phosphate synthase (EPSPS) encoding gene from the soil bacterium *Agrobacterium tumefaciens*, strain CP4. |
| SWP965001 | Cyanamid Crop Protection | Selection for a mutagenized version of the enzyme acetohydroxyacid synthase (AHAS), also known as acetolactate synthase (ALS) or acetolactate pyruvate-lyase. |
| Teal 11A | BASF Inc. | Selection for a mutagenized version of the enzyme acetohydroxyacid synthase (AHAS), also known as acetolactate synthase (ALS) or acetolactate pyruvate-lyase. |

TABLE 17

Sunflower Traits, which can be combined with microbes of the disclosure
*Helianthus annuus* Sunflower

| Event | Company | Description |
|---|---|---|
| X81359 | BASF Inc. | Tolerance to imidazolinone herbicides by selection of a naturally occurring mutant. |

TABLE 18

Soybean Traits, which can be combined with microbes of the disclosure
*Glycine max* L. Soybean

| Event | Company | Description |
|---|---|---|
| A2704-12, A2704-21, A5547-35 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| A5547-127 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| BPS-CV127-9 | BASF Inc. | The introduced csr1-2 gene from *Arabidopsis thaliana* encodes an acetohydroxyacid synthase protein that confers tolerance to imidazolinone herbicides due to a point mutation that results in a single amino acid substitution in which the serine residue at position 653 is replaced by asparagine (S653N). |
| DP-305423 | Pioneer Hi-Bred International Inc. | High oleic acid soybean produced by inserting additional copies of a portion of the omega 6 desaturase encoding gene, gm-fad2-1 resulting in silencing of the endogenous omega-6 desaturase gene (FAD2-1). |

TABLE 18-continued

| Soybean Traits, which can be combined with microbes of the disclosure *Glycine max* L. Soybean | | |
| --- | --- | --- |
| Event | Company | Description |
| DP356043 | Pioneer Hi-Bred International Inc. | Soybean event with two herbicide tolerance genes: glyphosate N-acetlytransferase, which detoxifies glyphosate, and a modified acetolactate synthase (ALS) gene which is tolerant to ALS-inhibiting herbicides. |
| G94-1, G94-19, G168 | DuPont Canada Agricultural Products | High oleic acid soybean produced by inserting a second copy of the fatty acid desaturase (Gm Fad2-1) encoding gene from soybean, which resulted in "silencing" of the endogenous host gene. |
| GTS 40-3-2 | Monsanto Company | Glyphosate tolerant soybean variety produced by inserting a modified 5-enolpyruvylshikimate-3-phosphate synthase (EPSPS) encoding gene from the soil bacterium *Agrobacterium tumefaciens.* |
| GU262 | Bayer CropScience (Aventis CropScience(AgrEvo)) | Glufosinate ammonium herbicide tolerant soybean produced by inserting a modified phosphinothricin acetyltransferase (PAT) encoding gene from the soil bacterium *Streptomyces viridochromogenes.* |
| MON87701 | Monsanto Company | Resistance to Lepidopteran pests of soybean including velvetbean caterpillar (*Anticarsia gemmatalis*) and soybean looper (*Pseudoplusia includens*). |
| MON87701 × MON89788 | Monsanto Company | Glyphosate herbicide tolerance through expression of the EPSPS encoding gene from *A. tumefaciens* strain CP4, and resistance to Lepidopteran pests of soybean including velvetbean caterpillar (*Anticarsia gemmatalis*) and soybean looper (*Pseudoplusia includens*) via expression of the Cry1Ac encoding gene from *B. thuringiensis.* |
| MON89788 | Monsanto Company | Glyphosate-tolerant soybean produced by inserting a modified 5-enolpyruvylshikimate-3-phosphate synthase (EPSPS) encoding aroA (epsps) gene from *Agrobacterium tumefaciens* CP4. |
| OT96-15 | Agriculture & Agri-Food Canada | Low linolenic acid soybean produced through traditional cross-breeding to incorporate the novel trait from a naturally occurring fan1 gene mutant that was selected for low linolenic acid. |
| W62, W98 | Bayer CropScience (Aventis CropScience(AgrEvo)) | Glufosinate ammonium herbicide tolerant soybean produced by inserting a modified phosphinothricin acetyltransferase (PAT) encoding gene from the soil bacterium *Streptomyces hygroscopicus.* |

TABLE 19

| Corn Traits, which can be combined with microbes of the disclosure | | |
| --- | --- | --- |
| *Zea mays* L. Maize | | |
| Event | Company | Description |
| 176 | Syngenta Seeds, Inc. | Insect-resistant maize produced by inserting the Cry1Ab gene from *Bacillus thuringiensis* subsp. *kurstaki*. The genetic modification affords resistance to attack by the European corn borer (ECB). |
| 3751 IR 676, 678, 680 | Pioneer Hi-Bred International Inc. Pioneer Hi-Bred International Inc. | Selection of somaclonal variants by culture of embryos on imidazolinone containing media. Male-sterile and glufosinate ammonium herbicide tolerant maize produced by inserting genes encoding DNA adenine methylase and phosphinothricin acetyltransferase (PAT) from *Escherichia coli* and *Streptomyces viridochromogenes*, respectively. |
| B16 (DLL25) | Dekalb Genetics Corporation | Glufosinate ammonium herbicide tolerant maize produced by inserting the gene encoding phosphinothricin acetyltransferase (PAT) from *Streptomyces hygroscopicus*. |
| BT11 (X4334CBR, X4734CBR) | Syngenta Seeds, Inc. | Insect-resistant and herbicide tolerant maize produced by inserting the Cry1Ab gene from *Bacillus thuringiensis* subsp. *kurstaki*, and the phosphinothricin N-acetyltransferase (PAT) encoding gene from *S. viridochromogenes*. |
| BT11 × GA21 | Syngenta Seeds, Inc. | Stacked insect resistant and herbicide tolerant maize produced by conventional cross breeding of parental lines BT11 (OECD unique identifier: SYN-BTO11-1) and GA21 (OECD unique identifier: MON-OOO21-9). |
| BT11 × MIR162 × MIR604 × GA21 | Syngenta Seeds, Inc. | Resistance to Coleopteran pests, particularly corn rootworm pests (*Diabrotica* spp.) and several Lepidopteran pests of corn, including European corn borer (ECB, *Ostrinia nubilalis*), corn earworm (CEW, *Helicoverpa zea*), fall army worm (FAW, *Spodoptera frugiperda*), and black cutworm (BCW, *Agrotis ipsilon*); tolerance to glyphosate and glufosinate-ammonium containing herbicides. |
| BT11 × MIR162 | Syngenta Seeds, Inc. | Stacked insect resistant and herbicide tolerant maize produced by conventional cross breeding of parental lines BT11 (OECD unique identifier: SYN-BTO11-1) and MIR162 (OECD unique identifier: SYN-1R162-4). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Resistance to other Lepidopteran pests, including *H. zea*, *S. frugiperda*, *A. ipsilon*, and *S. albicosta*, is derived from MIR162, which contains the vip3Aa gene from *Bacillus thuringiensis* strain AB88. |

TABLE 19-continued

| BT11 × MIR162 × MIR604 | Syngenta Seeds, Inc. | *Bacillus thuringiensis* Cry1Ab delta-endotoxin protein and the genetic material necessary for its production (via elements of vector pZO1502) in Event Bt11 corn (OECD Unique Identifier: SYNBTO11-1) × *Bacillus thuringiensis* Vip3Aa20 insecticidal protein and the genetic material necessary for its production (via elements of vector pNOV1300) in Event MIR162 maize (OECD Unique Identifier: SYN-IR162-4) × modified Cry3A protein and the genetic material necessary for its production (via elements of vector pZM26) in Event MIR604 corn (OECD Unique Identifier: SYN-1R604-5). |
|---|---|---|
| CBH-351 | Aventis CropScience | Insect-resistant and glufosinate ammonium herbicide tolerant maize developed by inserting genes encoding Cry9C protein from *Bacillus thuringiensis* subsp *tolworthi* and phosphinothricin acetyltransferase (PAT) from *Streptomyces hygroscopicus.* |
| DAS-06275-8 | DOW AgroSciences LLC | Lepidopteran insect resistant and glufosinate ammonium herbicide-tolerant maize variety produced by inserting the Cry1F gene from *Bacillus thuringiensis* var *aizawai* and the phosphinothricin acetyltransferase (PAT) from *Streptomyces hygroscopicus.* |
| BT11 × MIR604 | Syngenta Seeds, Inc. | Stacked insect resistant and herbicide tolerant maize produced by conventional cross breeding of parental lines BT11 (OECD unique identifier: SYN-BTO11-1) and MIR604 (OECD unique identifier: SYN-1R6O5-5). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes.* Corn rootworm -resistance is derived from MIR604 which contains the mCry3A gene from *Bacillus thuringiensis.* |
| BT11 × MIR604 × GA21 | Syngenta Seeds, Inc. | Stacked insect resistant and herbicide tolerant maize produced by conventional cross breeding of parental lines BT11 (OECD unique identifier: SYN-BTO11-1), MIR604 (OECD unique identifier: SYN-1R6O5-5) and GA21 (OECD unique identifier: MON-OOO21-9). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes.* Corn rootworm-resistance is derived from MIR604 which contains the mCry3A gene from *Bacillus thuringiensis.* Tolerance to glyphosate herbicide is derived |

TABLE 19-continued

| | | |
|---|---|---|
| | | from GA21 which contains a a modified EPSPS gene from maize. |
| DAS-59122-7 | DOW AgroSciences LLC and Pioneer Hi-Bred International Inc. | Corn rootworm-resistant maize produced by inserting the Cry34Ab1 and Cry35Ab1 genes from *Bacillus thuringiensis* strain PS149B1. The PAT encoding gene from *Streptomyces viridochromogenes* was introduced as a selectable marker. |
| DAS-59122-7 × TC1507 × NK603 | DOW AgroSciences LLC and Pioneer Hi-Bred International Inc. | Stacked insect resistant and herbicide tolerant maize produced by conventional cross breeding of parental lines DAS-59122-7 (OECD unique identifier: DAS-59122-7) and TC1507 (OECD unique identifier: DAS-01507-1) with NK603 (OECD unique identifier: MON-00603-6). Corn rootworm-resistance is derived from DAS-59122- 7 which contains the Cry34Abl and Cry35Abl genes from *Bacillus thuringiensis* strain P5149B1. Lepidopteran resistance and tolerance to glufosinate ammonium herbicide is derived from TC1507. Tolerance to glyphosate herbicide is derived from NK603. |
| DBT418 | Dekalb Genetics Corporation | Insect-resistant and glufosinate ammonium herbicide tolerant maize developed by inserting genes encoding Cry1AC protein from *Bacillus thuringiensis* subsp *kurstaki* and phosphinothricin acetyltransferase (PAT) from *Streptomyces hygroscopicus.* |
| MIR604 × GA21 | Syngenta Seeds, Inc. | Stacked insect resistant and herbicide tolerant maize produced by conventional cross breeding of parental lines MIR604 (OECD unique identifier: SYN-1R605-5) and GA21 (OECD unique identifier: MON-00021-9). Corn rootworm-resistance is derived from MIR604 which contains the mCry3A gene from *Bacillus thuringiensis.* Tolerance to glyphosate herbicide is derived from GA21. |
| MON80100 | Monsanto Company | Insect-resistant maize produced by inserting the Cry1Ab gene from *Bacillus thuringiensis* subsp. *kurstaki.* The genetic modification affords resistance to attack by the European corn borer (ECB). |
| MON802 | Monsanto Company | Insect-resistant and glyphosate herbicide tolerant maize produced by inserting the genes encoding the Cry1Ab protein from *Bacillus thuringiensis* and the 5-enolpyruvylshikimate-3-phosphate synthase (EPSPS) from *A. tumefaciens* strain CP4. |
| MON809 | Pioneer Hi-Bred International Inc. | Resistance to European corn borer (*Ostrinia nubilalis*) by introduction of a synthetic Cry1Ab gene. Glyphosate resistance via introduction of the bacterial version of a plant enzyme, 5-enolpynivyl shikimate-3-phosphate synthase (EPSPS). |
| MON810 | Monsanto Company | Insect-resistant maize produced by inserting a truncated form of the Cry1Ab gene from *Bacillus thuringiensis* subsp. *kurstaki* HD-1. The genetic modification affords resistance to attack by the European corn borer (ECB). |

TABLE 19-continued

| | | |
|---|---|---|
| MON810 × LY038 | Monsanto Company | Stacked insect resistant and enhanced lysine content maize derived from conventional crossbreeding of the parental lines MON810 (OECD identifier: MON-OO81O-6) and LY038 (OECD identifier: REN-OOO38-3). |
| MON810 × MON88017 | Monsanto Company | Stacked insect resistant and glyphosate tolerant maize derived from conventional cross-breeding of the parental lines MON810 (OECD identifier: MON-OO81O-6) and MON88017 (OECD identifier: MON-88017-3). European corn borer (ECB) resistance is derived from a truncated form of the Cry1Ab gene from *Bacillus thuringiensis* subsp. *kurstaki* HD-1 present in MON810. Corn rootworm resistance is derived from the Cry3Bbl gene from *Bacillus thuringiensis* subspecies *kumamotoensis* strain EG4691 present in MON88017. Glyphosate tolerance is derived from a 5-enolpyruvylshikimate-3-phosphate synthase (EPSPS) encoding gene from *Agrobacterium tumefaciens* strain CP4 present in MON88017. |
| MON832 | Monsanto Company | Introduction, by particle bombardment, of glyphosate oxidase (GOX) and a modified 5-enolpyruvyl shikimate-3-phosphate synthase (EPSPS), an enzyme involved in the shikimate biochemical pathway for the production of the aromatic amino acids. |
| MON863 | Monsanto Company | Corn rootworm resistant maize produced by inserting the Cry3Bbl gene from *Bacillus thuringiensis* subsp. *kumamotoensis*. |
| MON863 × MON810 | Monsanto Company | Stacked insect resistant corn hybrid derived from conventional cross-breeding of the parental lines MON863 (OECD identifier: MON-00863-5) and MON810 (OECD identifier: MON-00810-6) |
| MON863 × MON810 × Monsanto NK603 | Monsanto Company | Stacked insect resistant and herbicide tolerant corn hybrid derived from conventional crossbreeding of the stacked hybrid MON-00863-5 × MON-00810-6 and NK603 (OECD identifier: MON-00603-6). |
| MON863 × NK603 | Monsanto Company | Stacked insect resistant and herbicide tolerant corn hybrid derived from conventional crossbreeding of the parental lines MON863 (OECD identifier: MON-OO863-5) and NK603 (OECD identifier: MON-OO6O3-6). |
| MON87460 | Monsanto Company | MON 87460 was developed to provide reduced yield loss under water-limited conditions compared to conventional maize. Efficacy in MON 87460 is derived by expression of the inserted *Bacillus subtilis* cold shock protein B (CspB). |
| MON88017 | Monsanto Company | Corn rootworm-resistant maize produced by inserting the Cry3Bbl gene from *Bacillus thuringiensis* subspecies *kumamotoensis* strain EG4691. Glyphosate tolerance derived by inserting a 5-enolpyruvylshikimate-3-phosphate |

TABLE 19-continued

| | | synthase (EPSPS) encoding gene from *Agrobacterium tumefaciens* strain CP4. |
|---|---|---|
| MON89034 | Monsanto Company | Maize event expressing two different insecticidal proteins from *Bacillus thuringiensis* providing resistance to number of Lepidopteran pests. |
| MON89034 × MON88017 | Monsanto Company | Stacked insect resistant and glyphosate tolerant maize derived from conventional cross-breeding of the parental lines MON89034 (OECD identifier: MON-89O34-3) and MON88017 (OECD identifier: MON-88O17-3). Resistance to Lepidopteran insects is derived from two Cry genes present in MON89043. Corn rootworm resistance is derived from a single Cry genes and glyphosate tolerance is derived from the 5-enolpyruvylshikimate-3-phosphate synthase (EPSPS) encoding gene from *Agrobacterium tumefaciens* present in MON88017. |
| MON89034 × NK603 | Monsanto Company | Stacked insect resistant and herbicide tolerant maize produced by conventional cross breeding of parental lines MON89034 (OECD identifier: MON-89034-3) with NK603 (OECD unique identifier: MON-00603-6). Resistance to Lepidopteran insects is derived from two Cry genes present in MON89043. Tolerance to glyphosate herbicide is derived from NK603. |
| NK603 × MON810 | Monsanto Company | Stacked insect resistant and herbicide tolerant corn hybrid derived from conventional crossbreeding of the parental lines NK603 (OECD identifier: MON-00603-6) and MON810 (OECD identifier: MON-00810-6). |
| MON89034 × TC1507 × MON88017 × DAS-59122-7 | Monsanto Company and Mycogen Seeds c/o Dow AgroSciences LLC | Stacked insect resistant and herbicide tolerant maize produced by conventional cross breeding of parental lines: MON89034, TC1507, MON88017, and DAS-59 122. Resistance to the above-ground and below-ground insect pests and tolerance to glyphosate and glufosinate-ammonium containing herbicides. |
| M53 | Bayer CropScience (Aventis CropScience(AgrEvo)) | Male sterility caused by expression of the barnase ribonuclease gene from *Bacillus amyloliquefaciens*; PPT resistance was via PPT-acetyltransferase (PAT). |
| M56 | Bayer CropScience (Aventis CropScience(AgrEvo) | Male sterility caused by expression of the barnase ribonuclease gene from *Bacillus amyloliquefaciens*; PPT resistance was via PPT-acetyltransferase (PAT). |
| NK603 | Monsanto Company | Introduction, by particle bombardment, of a modified 5-enolpyruvyl shikimate-3-phosphate synthase (EPSPS), an enzyme involved in the shikimate biochemical pathway for the production of the aromatic amino acids. |
| NK603 × T25 | Monsanto Company | Stacked glufosinate ammonium and glyphosate herbicide tolerant maize hybrid derived from conventional cross-breeding of the parental lines NK603 (OECD identifier: MON-00603-6) and T25 (OECD identifier: ACS-ZM003-2). |

TABLE 19-continued

| | | |
|---|---|---|
| T25 × MON810 | Bayer CropScience (Aventis CropScience(AgrEvo)) | Stacked insect resistant and herbicide tolerant corn hybrid derived from conventional crossbreeding of the parental lines T25 (OECD identifier: ACS-ZMOO3-2) and MON810 (OECD identifier: MON-OO81O-6). |
| TC1507 | Mycogen (c/o Dow AgroSciences); Pioneer (c/o DuPont) | Insect-resistant and glufosinate ammonium herbicide tolerant maize produced by inserting the Cry1F gene from *Bacillus thuringiensis* var. *aizawai* and the phosphinothricin N-acetyltransferase encoding gene from *Streptomyces viridochromogenes.* |
| TC1507 × NK603 | DOW AgroSciences LLC | Stacked insect resistant and herbicide tolerant corn hybrid derived from conventional crossbreeding of the parental lines 1507 (OECD identifier: DAS-O15O7-1) and NK603 (OECD identifier: MON-OO6O3-6). |
| TC1507 × DAS-59122-7 | DOW AgroSciences LLC and Pioneer Hi-Bred International Inc. | Stacked insect resistant and herbicide tolerant maize produced by conventional cross breeding of parental lines TC1507 (OECD unique identifier: DAS-O15O7-1) with DAS-59122-7 (OECD unique identifier: DAS-59122-7). Resistance to Lepidopteran insects is derived from TC1507 due the presence of the Cry1F gene from *Bacillus thuringiensis* var. *aizawai.* Corn rootworm-resistance is derived from DAS-59122-7 which contains the Cry34Ab1 and Cry35Ab1 genes from *Bacillus thuringiensis* strain P5149B1. Tolerance to glufosinate ammonium herbicide is derived from TC1507 from the phosphinothricin N-acetyltransferase encoding gene from *Streptomyces viridochromogenes.* |

| Event | Company | Description | Hybrid Family |
|---|---|---|---|
| P0157 | Dupont Pioneer | | P0157 |
| P0157AM | Dupont Pioneer | AM LL RR2 | P0157 |
| P0157AMXT | Dupont Pioneer | AMXT LL RR2 | P0157 |
| P0157R | Dupont Pioneer | RR2 | P0157 |
| P0339AM | Dupont Pioneer | AM LL RR2 | P0339 |
| P0339AMXT | Dupont Pioneer | AMXT LL RR2 | P0339 |
| P0306AM | Dupont Pioneer | AM LL RR2 | P0306 |
| P0589 | Dupont Pioneer | | P0589 |
| P0589AM | Dupont Pioneer | AM LL RR2 | P0589 |
| P0589AMXT | Dupont Pioneer | AMXT LL RR2 | P0589 |
| P0589R | Dupont Pioneer | RR2 | P0589 |
| P0574 | Dupont Pioneer | | P0574 |
| P0574AM | Dupont Pioneer | AM LL RR2 | P0574 |
| P0574AMXT | Dupont Pioneer | AMXT LL RR2 | P0574 |
| P0533EXR | Dupont Pioneer | HXX LL RR2 | P0533 |
| P0506AM | Dupont Pioneer | AM LL RR2 | P0566 |
| P0760AMXT | Dupont Pioneer | AMXT LL RR2 | P0760 |
| P0707AM | Dupont Pioneer | AM LL RR2 | P0707 |
| P0707AMXT | Dupont Pioneer | AMXT LL RR2 | P0707 |
| P0825AM | Dupont Pioneer | AM LL RR2 | P0825 |
| P0825AMXT | Dupont Pioneer | AMXT LL RR2 | P0825 |
| P0969AM | Dupont Pioneer | AM LL RR2 | P0969 |
| P0969AMXT | Dupont Pioneer | AMXT LL RR2 | P0969 |
| P0937AM | Dupont Pioneer | AM LL RR2 | P0937 |
| P0919AM | Dupont Pioneer | AM LL RR2 | P0919 |
| P0905EXR | Dupont Pioneer | HXX LL RR2 | P0905 |
| P1197 | Dupont Pioneer | | P1197 |
| P1197AM | Dupont Pioneer | AM LL RR2 | P1197 |
| P1197AMXT | Dupont Pioneer | AMXT LL RR2 | P1197 |
| P1197R | Dupont Pioneer | RR2 | P1197 |
| P1151 | Dupont Pioneer | | P1151 |
| P1151AM | Dupont Pioneer | AM LL RR2 | P1151 |

TABLE 19-continued

| P1151R | Dupont Pioneer | RR2 | P1151 |
|---|---|---|---|
| P1138AM | Dupont Pioneer | AM LL RR2 | P1138 |
| P1366AM | Dupont Pioneer | AM LL RR2 | P1366 |
| P1366AMXT | Dupont Pioneer | AMXT LL RR2 | P1366 |
| P1365AMX | Dupont Pioneer | AMX LL RR2 | P1365 |
| P1353AM | Dupont Pioneer | AM LL RR2 | P1353 |
| P1345 | Dupont Pioneer | | P1345 |
| P1311AMXT | Dupont Pioneer | AMXT LL RR2 | P1311 |
| P1498EHR | Dupont Pioneer | HX1 LL RR2 | P1498 |
| P1498R | Dupont Pioneer | RR2 | P1498 |
| P1443AM | Dupont Pioneer | AM LL RR2 | P1443 |
| P1555CHR | Dupont Pioneer | RW HX1 LL RR2 | P1555 |
| P1751AMT | Dupont Pioneer | AMT LL RR2 | P1751 |
| P2089AM | Dupont Pioneer | AM LL RR2 | P2089 |
| QROME | Dupont Pioneer | Q LL RR2 | |

The following are the definitions for the shorthand occurring in Table 19. AM—OPTIMUM ACREMAX Insect Protection system with YGCB, HX1, LL, RR2. AMT—OPTIMUM ACREMAX TRISECT Insect Protection System with RW,YGCB,HX1,LL,RR2. AMXT—(OPTIMUM ACREMAX XTreme). HXX—HERCULEX XTRA contains the Herculex I and Herculex RW genes. HX1—Contains the HERCULEX I Insect Protection gene which provides protection against European corn borer, southwestern corn borer, black cutworm, fall armyworm, western bean cutworm, lesser corn stalk borer, southern corn stalk borer, and sugarcane borer; and suppresses corn earworm. LL—Contains the LIBERTYLINK gene for resistance to LIBERTY herbicide. RR2—Contains the ROUNDUP READY Corn 2 trait that provides crop safety for over-the-top applications of labeled glyphosate herbicides when applied according to label directions. YGCB—contains the YIELDGARD Corn Borer gene offers a high level of resistance to European corn borer, southwestern corn borer, and southern cornstalk borer; moderate resistance to corn earworm and common stalk borer; and above average resistance to fall armyworm. RW—contains the AGRISURE rootworm resistance trait. Q—provides protection or suppression against susceptible European corn borer, southwestern corn borer, black cutworm, fall armyworm, lesser corn stalk borer, southern corn stalk borer, stalk borer, sugarcane borer, and corn earworm; and also provides protection from larval injury caused by susceptible western corn rootworm, northern corn rootworm, and Mexican corn rootworm; contains (1) HERCULEX XTRA Insect Protection genes that produce Cry1F and Cry34ab1 and Cry35ab1 proteins, (2) AGRISURE RW trait that includes a gene that produces mCry3A protein, and (3) YIELDGARD Corn Borer gene which produces Cry1Ab protein.

Concentrations and Rates of Application of Agricultural Compositions

As aforementioned, the agricultural compositions of the present disclosure, which comprise a taught microbe, can be applied to plants in a multitude of ways. In two particular aspects, the disclosure contemplates an in-furrow treatment or a seed treatment For seed treatment embodiments, the microbes of the disclosure can be present on the seed in a variety of concentrations. For example, the microbes can be found in a seed treatment at a cfu concentration, per seed of: $1 \times 10^1$, $1 \times 10^2$, $1 \times 10^3$, $1 \times 10^4$, $1 \times 10^5$, $1 \times 10^6$, $1 \times 10^7$, $1 \times 10^8$, $1 \times 10^9$, $1 \times 10^{10}$, or more. In particular aspects, the seed treatment compositions comprise about $1 \times 10^4$ to about $1 \times 10^8$ cfu per seed. In other particular aspects, the seed treatment compositions comprise about $1 \times 10^5$ to about $1 \times 10^7$ cfu per seed. In other aspects, the seed treatment compositions comprise about $1 \times 10^6$ cfu per seed.

In the United States, about 10% of corn acreage is planted at a seed density of above about 36,000 seeds per acre; ⅓ of the corn acreage is planted at a seed density of between about 33,000 to 36,000 seeds per acre; ⅓ of the corn acreage is planted at a seed density of between about 30,000 to 33,000 seeds per acre, and the remainder of the acreage is variable. See, "Corn Seeding Rate Considerations," written by Steve Butzen, available at: www.pioneer.com/home/site/us/agronomy/library/corn-seeding-rate-considerations/.

Table 20 below utilizes various cfu concentrations per seed in a contemplated seed treatment embodiment (rows across) and various seed acreage planting densities (1st column: 15K-41K) to calculate the total amount of cfu per acre, which would be utilized in various agricultural scenarios (i.e. seed treatment concentration per seed× seed density planted per acre). Thus, if one were to utilize a seed treatment with $1 \times 10^6$ cfu per seed and plant 30,000 seeds per acre, then the total cfu content per acre would be $3 \times 10^{10}$ (i.e. 30K*$1 \times 10^6$).

TABLE 20

Total CFU Per Acre Calculation for Seed Treatment Embodiments

| Corn Population (i.e. seeds per acre) | 1.00E+02 | 1.00E+03 | 1.00E+04 | 1.00E+05 | 1.00E+06 | 1.00E+07 | 1.00E+08 | 1.00E+09 |
|---|---|---|---|---|---|---|---|---|
| 15,000 | 1.50E+06 | 1.50E+07 | 1.50E+08 | 1.50E+09 | 1.50E+10 | 1.50E+11 | 1.50E+12 | 1.50E+13 |
| 16,000 | 1.60E+06 | 1.60E+07 | 1.60E+08 | 1.60E+09 | 1.60E+10 | 1.60E+11 | 1.60E+12 | 1.60E+13 |
| 17,000 | 1.70E+06 | 1.70E+07 | 1.70E+08 | 1.70E+09 | 1.70E+10 | 1.70E+11 | 1.70E+12 | 1.70E+13 |
| 18,000 | 1.80E+06 | 1.80E+07 | 1.80E+08 | 1.80E+09 | 1.80E+10 | 1.80E+11 | 1.80E+12 | 1.80E+13 |
| 19,000 | 1.90E+06 | 1.90E+07 | 1.90E+08 | 1.90E+09 | 1.90E+10 | 1.90E+11 | 1.90E+12 | 1.90E+13 |
| 20,000 | 2.00E+06 | 2.00E+07 | 2.00E+08 | 2.00E+09 | 2.00E+10 | 2.00E+11 | 2.00E+12 | 2.00E+13 |
| 21,000 | 2.10E+06 | 2.10E+07 | 2.10E+08 | 2.10E+09 | 2.10E+10 | 2.10E+11 | 2.10E+12 | 2.10E+13 |
| 22,000 | 2.20E+06 | 2.20E+07 | 2.20E+08 | 2.20E+09 | 2.20E+10 | 2.20E+11 | 2.20E+12 | 2.20E+13 |
| 23,000 | 2.30E+06 | 2.30E+07 | 2.30E+08 | 2.30E+09 | 2.30E+10 | 2.30E+11 | 2.30E+12 | 2.30E+13 |

TABLE 20-continued

Total CFU Per Acre Calculation for Seed Treatment Embodiments

| Corn Population (i.e. seeds per acre) | 1.00E+02 | 1.00E+03 | 1.00E+04 | 1.00E+05 | 1.00E+06 | 1.00E+07 | 1.00E+08 | 1.00E+09 |
|---|---|---|---|---|---|---|---|---|
| 24,000 | 2.40E+06 | 2.40E+07 | 2.40E+08 | 2.40E+09 | 2.40E+10 | 2.40E+11 | 2.40E+12 | 2.40E+13 |
| 25,000 | 2.50E+06 | 2.50E+07 | 2.50E+08 | 2.50E+09 | 2.50E+10 | 2.50E+11 | 2.50E+12 | 2.50E+13 |
| 26,000 | 2.60E+06 | 2.60E+07 | 2.60E+08 | 2.60E+09 | 2.60E+10 | 2.60E+11 | 2.60E+12 | 2.60E+13 |
| 27,000 | 2.70E+06 | 2.70E+07 | 2.70E+08 | 2.70E+09 | 2.70E+10 | 2.70E+11 | 2.70E+12 | 2.70E+13 |
| 28,000 | 2.80E+06 | 2.80E+07 | 2.80E+08 | 2.80E+09 | 2.80E+10 | 2.80E+11 | 2.80E+12 | 2.80E+13 |
| 29,000 | 2.90E+06 | 2.90E+07 | 2.90E+08 | 2.90E+09 | 2.90E+10 | 2.90E+11 | 2.90E+12 | 2.90E+13 |
| 30,000 | 3.00E+06 | 3.00E+07 | 3.00E+08 | 3.00E+09 | 3.00E+10 | 3.00E+11 | 3.00E+12 | 3.00E+13 |
| 31,000 | 3.10E+06 | 3.10E+07 | 3.10E+08 | 3.10E+09 | 3.10E+10 | 3.10E+11 | 3.10E+12 | 3.10E+13 |
| 32,000 | 3.20E+06 | 3.20E+07 | 3.20E+08 | 3.20E+09 | 3.20E+10 | 3.20E+11 | 3.20E+12 | 3.20E+13 |
| 33,000 | 3.30E+06 | 3.30E+07 | 3.30E+08 | 3.30E+09 | 3.30E+10 | 3.30E+11 | 3.30E+12 | 3.30E+13 |
| 34,000 | 3.40E+06 | 3.40E+07 | 3.40E+08 | 3.40E+09 | 3.40E+10 | 3.40E+11 | 3.40E+12 | 3.40E+13 |
| 35,000 | 3.50E+06 | 3.50E+07 | 3.50E+08 | 3.50E+09 | 3.50E+10 | 3.50E+11 | 3.50E+12 | 3.50E+13 |
| 36,000 | 3.60E+06 | 3.60E+07 | 3.60E+08 | 3.60E+09 | 3.60E+10 | 3.60E+11 | 3.60E+12 | 3.60E+13 |
| 37,000 | 3.70E+06 | 3.70E+07 | 3.70E+08 | 3.70E+09 | 3.70E+10 | 3.70E+11 | 3.70E+12 | 3.70E+13 |
| 38,000 | 3.80E+06 | 3.80E+07 | 3.80E+08 | 3.80E+09 | 3.80E+10 | 3.80E+11 | 3.80E+12 | 3.80E+13 |
| 39,000 | 3.90E+06 | 3.90E+07 | 3.90E+08 | 3.90E+09 | 3.90E+10 | 3.90E+11 | 3.90E+12 | 3.90E+13 |
| 40,000 | 4.00E+06 | 4.00E+07 | 4.00E+08 | 4.00E+09 | 4.00E+10 | 4.00E+11 | 4.00E+12 | 4.00E+13 |
| 41,000 | 4.10E+06 | 4.10E+07 | 4.10E+08 | 4.10E+09 | 4.10E+10 | 4.10E+11 | 4.10E+12 | 4.10E+13 |

For in-furrow embodiments, the microbes of the disclosure can be applied at a cfu concentration per acre of: $1 \times 10^6$, $3.20 \times 10^{10}$, $1.60 \times 10^{11}$, $3.20 \times 10^{11}$, $8.0 \times 10^{11}$, $1.6 \times 10^{12}$, $3.20 \times 10^{12}$, or more. Therefore, in aspects, the liquid in-furrow compositions can be applied at a concentration of between about $1 \times 10^6$ to about $3 \times 10^{12}$ cfu per acre.

In some aspects, the in-furrow compositions are contained in a liquid formulation. In the liquid in-furrow embodiments, the microbes can be present at a cfu concentration per milliliter of: $1 \times 10^1$, $1 \times 10^2$, $1 \times 10^3$, $1 \times 10^4$, $1 \times 10^5$, $1 \times 10^6$, $1 \times 10^7$, $1 \times 10^8$, $1 \times 10^9$, $1 \times 10^{10}$, $1 \times 10^{11}$, $1 \times 10^{12}$, $1 \times 10^{13}$, or more. In certain aspects, the liquid in-furrow compositions comprise microbes at a concentration of about $1 \times 10^6$ to about $1 \times 10^{11}$ cfu per milliliter. In other aspects, the liquid in-furrow compositions comprise microbes at a concentration of about $1 \times 10^7$ to about $1 \times 10^{10}$ cfu per milliliter. In other aspects, the liquid in-furrow compositions comprise microbes at a concentration of about $1 \times 10^8$ to about $1 \times 10^9$ cfu per milliliter. In other aspects, the liquid in-furrow compositions comprise microbes at a concentration of up to about $1 \times 10^{13}$ cfu per milliliter.

Transcriptomic Profiling of Candidate Microbes

Previous work by the inventors entailed transcriptomic profiling of strain CI010 to identify promoters that are active in the presence of environmental nitrogen. Strain CI010 was cultured in a defined, nitrogen-free media supplemented with 10 mM glutamine. Total RNA was extracted from these cultures (QIAGEN RNeasy kit) and subjected to RNAseq sequencing via Illumina HiSeq (SeqMatic, Fremont CA). Sequencing reads were mapped to the CI010 genome data using Geneious, and highly expressed genes under control of proximal transcriptional promoters were identified.

Tables 21-23 lists genes and their relative expression level as measured through RNASeq sequencing of total RNA. Sequences of the proximal promoters were recorded for use in mutagenesis of nif pathways, nitrogen utilization related pathways, or other genes with a desired expression level.

TABLE 21

| Name | Minimum | Maximum | Length | Direction |
|---|---|---|---|---|
| murein lipoprotein CDS | 2,929,898 | 2,930,134 | 237 | forward |
| membrane protein CDS | 5,217,517 | 5,217,843 | 327 | forward |
| zinc/cadmium-binding protein CDS | 3,479,979 | 3,480,626 | 648 | forward |
| acyl carrier protein CDS | 4,563,344 | 4,563,580 | 237 | reverse |
| ompX CDS | 4,251,002 | 4,251,514 | 513 | forward |
| DNA-binding protein HU-beta CDS | 375,156 | 375,428 | 273 | forward |
| sspA CDS | 629,998 | 630,636 | 639 | reverse |
| taffi CDS | 3,199,435 | 3,199,638 | 204 | reverse |
| LexA repressor CDS | 1,850,457 | 1,851,065 | 609 | forward |
| hisS CDS | <3999979 | 4,001,223 | >1245 | forward |

TABLE 22

| Name | Differential Expression Absolute Confidence | Differential Expression Ratio | RNASeq_nifL - Raw Read Count | RNASeq_nifL - Raw Transcript Count | RNASeq_WT - Raw Read Count | RNASeq_WT - Raw Transcript Count |
|---|---|---|---|---|---|---|
| murein lipoprotein CDS | 1000 | −1.8 | 12950.5 | 10078.9 | 5151.5 | 4106.8 |
| membrane protein CDS | 1000 | −1.3 | 9522.5 | 5371.3 | 5400 | 3120 |
| zinc/cadmium-binding protein CDS | 3.3 | 1.1 | 6461 | 1839.1 | 5318 | 1550.6 |
| acyl carrier protein CDS | 25.6 | 1.6 | 1230.5 | 957.6 | 1473.5 | 1174.7 |

TABLE 22-continued

| Name | Differential Expression Absolute Confidence | Differential Expression Ratio | RNASeq_nifL - Raw Read Count | RNASeq_nifL - Raw Transcript Count | RNASeq_WT - Raw Read Count | RNASeq_WT - Raw Transcript Count |
|---|---|---|---|---|---|---|
| ompX CDS | 1.7 | 1.1 | 2042 | 734.2 | 1687.5 | 621.5 |
| DNA-binding protein HU-beta CDS | 6.9 | −1.3 | 1305 | 881.7 | 725 | 501.8 |
| sspA CDS | 0.2 | 1 | 654 | 188.8 | 504.5 | 149.2 |
| tatE CDS | 1.4 | 1.3 | 131 | 118.4 | 125 | 115.8 |
| LexA repressor CDS | 0.1 | −1.1 | 248 | 75.1 | 164 | 50.9 |
| hisS CDS | 0 | −1.1 | 467 | 69.2 | 325 | 49.3 |

TABLE 23

| Name | Prm (In Forward direction, −250 to +10 region) SEQ ID NO: | Expressed Sequence SEQ ID NO: | Neighbor Sequence SEQ ID NO: |
|---|---|---|---|
| murein lipoprotein CDS | SEQ ID NO: 3 | SEQ ID NO: 13 | SEQ ID NO: 23 |
| membrane protein CDS | SEQ ID NO: 4 | SEQ ID NO: 14 | SEQ ID NO: 24 |
| zinc/cadmium-binding protein CDS | SEQ ID NO: 5 | SEQ ID NO: 15 | SEQ ID NO: 25 |
| acyl carrier protein CDS | SEQ ID NO: 6 | SEQ ID NO: 16 | SEQ ID NO: 26 |
| ompX CDS | SEQ ID NO: 7 | SEQ ID NO: 17 | SEQ ID NO. 27 |
| DNA-binding protein HU-beta CDS | SEQ ID NO: 8 | SEQ ID NO: 18 | SEQ ID NO: 28 |
| sspA CDS | SEQ ID NO: 9 | SEQ ID NO: 19 | SEQ ID NO: 29 |
| tatE CDS | SEQ ID NO: 10 | SEQ ID NO: 20 | SEQ ID NO: 30 |
| LexA repressor CDS | SEQ ID NO: 11 | SEQ ID NO: 21 | SEQ ID NO: 31 |
| hisS CDS | SEQ ID NO: 12 | SEQ ID NO: 22 | SEQ ID NO: 32 |

TABLE 24

Table of Strains

| Name | Lineage | Mutagenic DNA Description | Genotype | Gene 1 mutation | Gene 2 mutation |
|---|---|---|---|---|---|
| CI006 | Isolated strain from *Enterobacter* (now *Kosakonia*) genera | None | WT | | |
| CI008 | Isolated strain from *Burkholderia* (now *Paraburkholderia*) genera | None | WT | | |
| CI010 | Isolated strain from *Klebsiella* genera | None | WT | | |
| CI019 | Isolated strain from *Rahnella* genera | None | WT | | |
| CI028 | Isolated strain from *Enterobacter* genera | None | WT | | |
| CI050 | Isolated strain from *Klebsiella* genera | None | WT | | |
| CM002 | Mutant of CI050 | Disruption of nifL gene with a kanamycin resistance expression cassette (KanR) encoding the aminoglycoside O-phosphotransferase gene aph1 inserted. | ΔnifL::KanR | SEQ ID NO: 33 | |
| CM011 | Mutant of CI019 | Disruption of nifL gene with a spectinomycin resistance expression cassette (SpecR) encoding the streptomycin 3″-O-adenylyltransferase gene aadA inserted. | ΔnifL::SpecR | SEQ ID NO: 34 | |

TABLE 24-continued

Table of Strains

| Name | Lineage | Mutagenic DNA Description | Genotype | Gene 1 mutation | Gene 2 mutation |
|------|---------|---------------------------|----------|-----------------|-----------------|
| CM013 | Mutant of CI006 | Disruption of nifL gene with a kanamycin resistance expression cassette (KanR) encoding the aminoglycoside O-phosphotransferase gene aph1 inserted. | ΔnifL::KanR | SEQ ID NO: 35 | |
| CM004 | Mutant of CI010 | Disruption of amtB gene with a kanamycin resistance expression cassette (KanR) encoding the aminoglycoside O-phosphotransferase gene aph1 inserted. | ΔamtB::KanR | SEQ ID NO: 36 | |
| CM005 | Mutant of CI010 | Disruption of nifL gene with a kanamycin resistance expression cassette (KanR) encoding the aminoglycoside O-phosphotransferase gene aph1 inserted. | ΔnifL::KanR | SEQ ID NO: 37 | |
| CM015 | Mutant of CI006 | Disruption of nifL gene with a fragment of the region upstream of the ompX gene inserted (Prm5). | ΔnifL::Prm5 | SEQ ID NO: 38 | |
| CM021 | Mutant of CI006 | Disruption of nifL gene with a fragment of the region upstream of an unannotated gene and the first 73 bp of that gene inserted (Prm2). | ΔnifL::Prm2 | SEQ ID NO: 39 | |
| CM023 | Mutant of CI006 | Disruption of nifL gene with a fragm ent of the region upstream of the acpP gene and the first 121 bp of the acpP gene inserted (Prm4). | ΔnifL::Prm4 | SEQ ID NO: 40 | |
| CM014 | Mutant of CI006 | Disruption of nifL gene with a fragment of the region upstream of the lpp gene and the first 29 bp of the lpp gene inserted (Prm1). | ΔnifL::Prm1 | SEQ ID NO: 41 | |
| CM016 | Mutant of CI006 | Disruption of nifL gene with a fragment of the region upstream of the lexA 3 gene and the first 21 bp of the lexA 3 gene inserted (Prm9). | ΔnifL::Prm9 | SEQ ID NO: 42 | |
| CM022 | Mutant of CI006 | Disruption of nifL gene with a fragment of the region upstream of the mntP 1 gene and the first 53 bp of the mntP 1 gene inserted (Prm3). | ΔnifL::Prm3 | SEQ ID NO: 43 | |
| CM024 | Mutant of CI006 | Disruption of nifL gene with a fragment of the region upstream of the sspA gene inserted (Prm7). | ΔnifL::Prm7 | SEQ ID NO: 44 | |
| CM025 | Mutant of CI006 | Disruption of nifL gene with a fragment of the region upstream of the hisS gene and the first 52 bp of the hisS gene inserted (Prm10). | ΔnifL::Prm10 | SEQ ID NO: 45 | |
| CM006 | Mutant of CI010 | Disruption of glnB gene with a kanamycin resistance expression cassette (KanR) encoding the aminoglycoside O-phosphotransferase gene aph1 inserted. | ΔglnB::KanR | SEQ ID NO: 46 | |

TABLE 24-continued

| | | | | Gene 1 | Gene 2 |
|---|---|---|---|---|---|
| Name | Lineage | Mutagenic DNA Description | Genotype | mutation | mutation |
| CM017 | Mutant of CI028 | Disruption of nifL gene with a kanamycin resistance expression cassette (KanR) encoding the aminoglycoside O-phosphotransferase gene aph1 inserted. | ΔnifL::KanR | SEQ ID NO: 47 | |
| CM011 | Mutant of CI019 | Disruption of nifL gene with a spectinomycin resistance expression cassette (SpecR) encoding the streptomycin 3"-O-adenylyltransferase gene aadA inserted. | ΔnifL::SpecR | SEQ ID NO: 48 | |
| CM013 | Mutant of CI006 | Disruption of nifL gene with a kanamycin resistance expression cassette (KanR) encoding the aminoglycoside O-phosphotransferase gene aph1 inserted. | ΔnifL::KanR | SEQ ID NO: 49 | |
| CM005 | Mutant of CI010 | Disruption of nifL gene with a kanamycin resistance expression cassette (KanR) encoding the aminoglycoside O-phosphotransferase gene aph1 inserted. | ΔnifL::KanR | SEQ ID NO: 50 | |
| CM014 | Mutant of CI006 | Disruption of nifL gene with a fragment of the region upstream of the lpp gene and the first 29 bp of the lpp gene inserted (Prm1). | ΔnifL::Prm1 | SEQ ID NO: 51 | |
| CM015 | Mutant of CI006 | Disruption of nifL gene with a fragment of the region upstream of the ompX gene inserted (Pnn5). | ΔnifL::Prm5 | SEQ ID NO: 52 | |
| CM023 | Mutant of CI006 | Disruption of nifL gene with a fragment of the region upstream of the acpP gene and the first 121 bp of the acpP gene inserted (Prm4). | ΔnifL::Prm4 | SEQ ID NO: 53 | |
| CM029 | Mutant of CI006 | Disruption of nifL gene with a fragment of the region upstream of the ompX gene inserted (Prm5) and deletion of the 1287 bp after the start codon of the glnE gene containing the adenylyl-removing domain of glutamate-ammonia-ligase adenylyltransferase (ΔglnE-AR_KO1). | ΔnifL::Prm5 ΔglnE-AR_KO1 | SEQ ID NO: 54 | SEQ ID NO: 61 |
| CM014 | Mutant of CI006 | Disruption of nifL gene with a fragment of the region upstream of the lpp gene and the first 29 bp of the lpp gene inserted (Prm1). | ΔnifL::Prm1 | SEQ ID NO: 55 | |
| CM011 | Mutant of CI019 | Disruption of nifL gene with a spectinomycin resistance expression cassette (SpecR) encoding the streptomycin 3"-O-adenylyltransferase gene aadA inserted. | ΔnifL::SpecR | SEQ ID NO: 56 | |
| CM011 | Mutant of CI019 | Disruption of nifL gene with a spectinomycin resistance expression cassette (SpecR) encoding the streptomycin 3"-O-adenylyltransferase gene aadA inserted. | ΔnifL::SpecR | SEQ ID NO: 57 | |

TABLE 24-continued

Table of Strains

| Name | Lineage | Mutagenic DNA Description | Genotype | Gene 1 mutation | Gene 2 mutation |
|------|---------|--------------------------|----------|-----------------|-----------------|
| CM013 | Mutant of CI006 | Disruption of nifL gene with a kanamycin resistance expression cassette (KanR) encoding the aminoglycoside O-phosphotransferase gene aph1 inserted. | ΔnifL::KanR | SEQ ID NO: 58 | |
| CM011 | Mutant of CI019 | Disruption of nifL gene with a spectinomycin resistance expression cassette (SpecR) encoding the streptomycin 3"-O-adenylyltransferase gene aadA inserted. | ΔnifL::SpecR | SEQ ID NO: 59 | |
| CM011 | Mutant of CI019 | Disruption of nifL gene with a spectinomycin resistance expression cassette (SpecR) encoding the streptomycin 3"-O-adenylyltransferase gene aadA inserted. | ΔnifL::SpecR | SEQ ID NO: 60 | |

EXAMPLES

The following examples are given for the purpose of illustrating various embodiments of the disclosure and are not meant to limit the present disclosure in any fashion. Changes therein and other uses which are encompassed within the spirit of the disclosure, as defined by the scope of the claims, will be recognized by those skilled in the art.

Example 1: Guided Microbial Remodeling—A Platform for the Rational Improvement of Microbial Species for Agriculture An example overview of an embodiment of the Guided Microbial Remodeling (GMR) platform can be summarized in the schematic of FIG. 1A.

FIG. 1A illustrates that the composition of the microbiome can first be characterized and a species of interest is identified (e.g. to find a microbe with the appropriate colonization characteristics).

The metabolism of the species of interest can be mapped and linked to genetics. For example, the nitrogen fixation pathway of the microbe can be characterized. The pathway that is being characterized can be examined under a range of environmental conditions. For example, the microbe's ability to fix atmospheric nitrogen in the presence of various levels of exogenous nitrogen in its environment can be examined. The metabolism of nitrogen can involve the entrance of ammonia ($NH_4^+$) from the rhizosphere into the cytosol of the bacteria via the AmtB transporter. Ammonia and L-glutamate (L-Glu) are catalyzed by glutamine synthetase and ATP into glutamine. Glutamine can lead to the formation of bacterial biomass and it can also inhibit expression of the nif operon, i.e. it can be a competing force when one desires the microbe to fix atmospheric nitrogen and excrete ammonia. The nitrogen fixation pathway is characterized in great detail in earlier sections of the specification.

Afterwards, a targeted non-intergeneric genomic alteration can be introduced to the microbe's genome, using methods including, but not limited to: conjugation and recombination, chemical mutagenesis, adaptive evolution, and gene editing. The targeted non-intergeneric genomic alteration can include an insertion, disruption, deletion, alteration, perturbation, modification, etc. of the genome.

Derivative remodeled microbes, which comprise the desired phenotype resulting from the remodeled underlying genotype, are then used to inoculate crops.

The present disclosure provides, in certain embodiments, non-intergeneric remodeled microbes that are able to fix atmospheric nitrogen and supply such nitrogen to a plant. In aspects, these non-intergeneric remodeled microbes are able to fix atmospheric nitrogen, even in the presence of exogenous nitrogen.

Figure 1B:
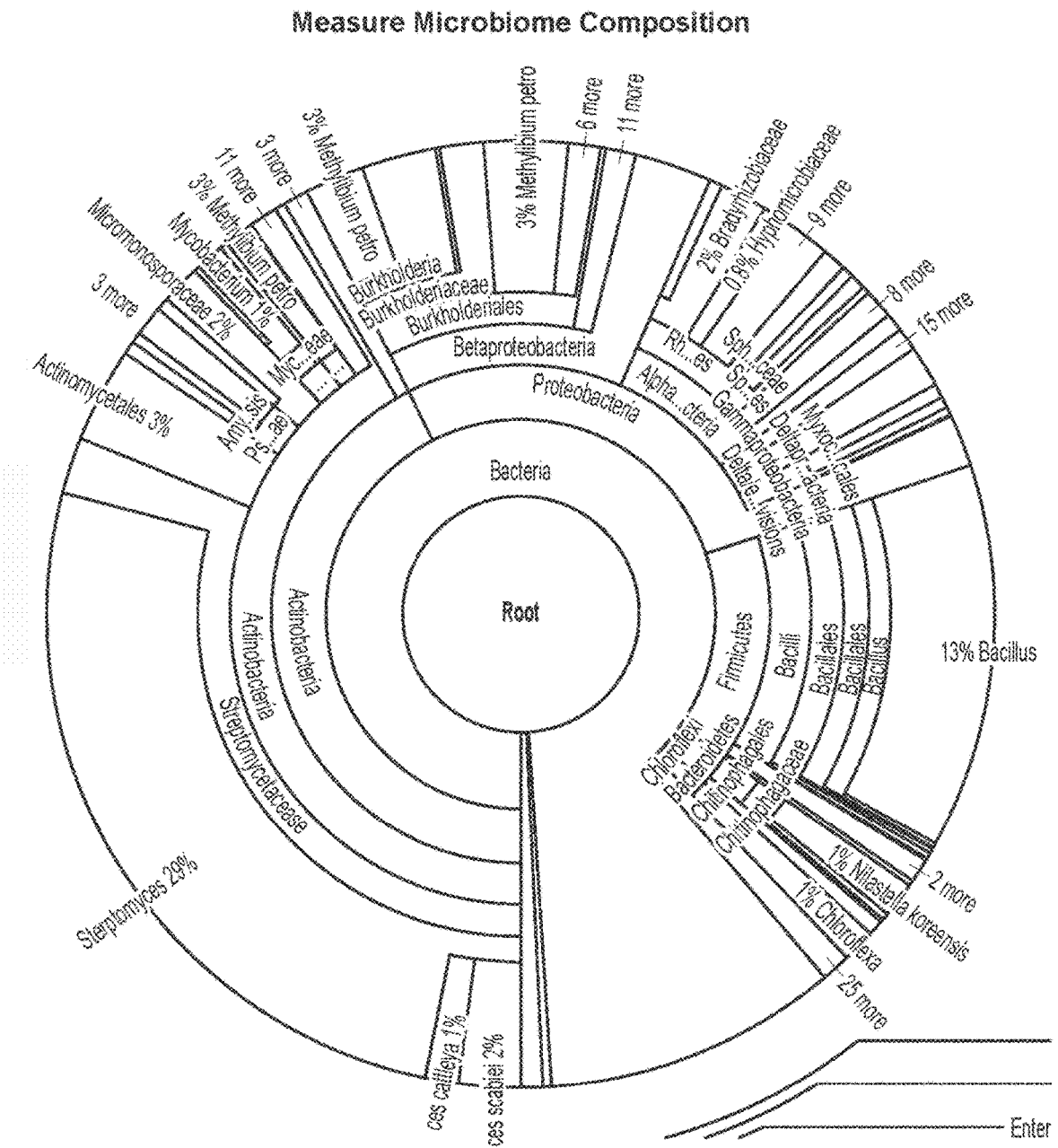
FIG. 1B depicts an expanded view of the measurement of microbiome composition as shown in FIG. 1A.

FIG. 1B depicts an expanded view of the measurement of the microbiome step. In some embodiments, the present disclosure finds microbial species that have desired colonization characteristics, and then utilizes those species in the subsequent remodeling process.

The aforementioned Guided Microbial Remodeling (GMR) platform will now be described with more specificity.

In aspects, the GMR platform comprises the following steps:

A. Isolation—Obtain microbes from the soil, rhizosphere, surface, etc. of a crop plant of interest;

B. Characterization—Involves characterizing the isolated microbes for genotype/phenotypes of interest (e.g. genome sequence, colonization ability, nitrogen fixation activity, solubilization of P ability, excretion of a metabolite of interest, excretion of a plant promoting compound, etc.)

C. Domestication—Development of a molecular protocol for non-intergeneric genetic modification of the microbe;

D. Non-Intergeneric Engineering Campaign and Optimization—Generation of derivative non-intergeneric microbial strains with genetic modifications in key pathways (e.g. colonization associated genes, nitrogen fixation/assimilation genes, P solubilization genes);

E. Analytics—Evaluation of derived non-intergeneric strains for phenotypes of interest both in vitro (e.g., ARA assays) and in planta (e.g. colonization assays).

F. Iterate Engineering Campaign/Analytics—Iteration of steps D and E for further improvement of microbial strain.

Each of the GMR platform process steps will now be elaborated upon below.

A. Isolation of Microbes

1. Obtain a Soil Sample

Microbes will be isolated from soil and/or roots of a plant. In one example, plants will be grown in a laboratory or a greenhouse in small pots. Soil samples will be obtained from various agricultural areas. For example, soils with diverse texture characteristics can be collected, including loam (e.g. peaty clay loam, sandy loam), clay soil (e.g. heavy clay, silty clay), sandy soil, silty soil, peaty soil, chalky soil, and the like.

2. Grow Bait Plants

Seeds of a bait plant (a plant of interest) (e.g. corn, wheat, rice, *sorghum*, millet, soybean, vegetables, fruits, etc.) will be planted into each soil type. In one example, different varieties of a bait plant will be planted in various soil types. For example, if the plant of interest is corn, seeds of different varieties of corn such as field corn, sweet corn, heritage corn, etc. will be planted in various soil types described above.

3. Harvest Soil and/or Root Samples and Plate on Appropriate Medium

Plants will be harvested by uprooting them after a few weeks (e.g. 2-4 weeks) of growth. Alternative to growing plants in a laboratory/greenhouse, soil and/or roots of the plant of interest can be collected directly from the fields with different soil types.

To isolate rhizosphere microbes and epiphytes, plants will be removed gently by saturating the soil with distilled water or gently loosening the soil by hand to avoid damage to the roots. If larger soil particles are present, these particles will be removed by submerging the roots in a still pool of distilled water and/or by gently shaking the roots. The root will be cut and a slurry of the soil sticking to the root will be prepared by placing the root in a plate or tube with small amount of distilled water and gently shaking the plate/tube on a shaker or centrifuging the tube at low speed. This slurry will be processed as described below.

To isolate endophytes, excess soil on root surfaces will be removed with deionized water. Following soil removal, plants will be surface sterilized and rinsed vigorously in sterile water. A cleaned, 1 cm section of root will be excised from the plant and placed in a phosphate buffered saline solution containing 3 mm steel beads. A slurry will be generated by vigorous shaking of the solution with a Qiagen TissueLyser II.

The soil and/or root slurry can be processed in various ways depending on the desired plant-beneficial trait of microbes to be isolated. For example, the soil and root slurry can be diluted and inoculated onto various types of screening media to isolate rhizospheric, endophytic, epiphytic, and other plant-associated microbes. For example, if the desired plant-beneficial trait is nitrogen fixation, then the soil/root slurry will be plated on a nitrogen free media (e.g. Nfb agar media) to isolate nitrogen fixing microbes. Similarly, to isolate phosphate solubilizing bacteria (PSB), media containing calcium phosphate as the sole source of phosphorus can be used. PSB can solubilize calcium phosphate and assimilate and release phosphorus in higher amounts. This reaction is manifested as a halo or a clear zone on the plate and can be used as an initial step for isolating PSB.

4. Pick Colonies, Purify Cultures, and Screen for the Presence of Genes of Interest Populations of microbes obtained in step A3 are streaked to obtain single colonies (pure cultures). A part of the pure culture is resuspended in a suitable medium (e.g. a mixture of R2A and glycerol) and subjected to PCR analysis to screen for the presence of one or more genes of interest. For example, to identify nitrogen fixing bacteria (diazotrophs), purified cultures of isolated microbes can be subjected to a PCR analysis to detect the presence of nif genes that encode enzymes involved in the fixation of atmospheric nitrogen into a form of nitrogen available to living organisms.

5. Bank a Purified Culture

Purified cultures of isolated strains will be stored, for example at −80° C., for future reference and analysis.

B. Characterization of Isolated Microbes

1. Phylogenetic Characterization and Whole Genome Sequencing

Isolated microbes will be analyzed for phylogenetic characterization (assignment of genus and species) and the whole genome of the microbes will be sequenced.

For phylogenetic characterization, 16S rDNA of the isolated microbe will be sequenced using degenerate 16S rDNA primers to generate phylogenetic identity. The 16S rDNA sequence reads will be mapped to a database to initially assign the genus, species and strain name for isolated microbes. Whole genome sequencing is used as the final step to assign phylogenetic genus/species to the microbes.

The whole genome of the isolated microbes will be sequenced to identify key pathways. For the whole genome sequencing, the genomic DNA will be isolated using a genomic DNA isolation kit (e.g. QIAmp DNA mini kit from QIAGEN) and a total DNA library will be prepared using the methods known in the art. The whole genome will be sequenced using high throughput sequencing (also called Next Generation Sequencing) methods known in the art. For example, Illumina, Inc., Roche, and Pacific Biosciences provide whole genome sequencing tools that can be used to prepare total DNA libraries and perform whole genome sequencing.

The whole genome sequence for each isolated strain will be assembled; genes of interest will be identified; annotated; and noted as potential targets for remodeling. The whole genome sequences will be stored in a database.

2. Assay the Microbe for Colonization of a Host Plant in a Greenhouse

Isolated microbes will be characterized for the colonization of host plants in a greenhouse. For this, seeds of the desired host plant (e.g., corn, wheat, rice, *sorghum*, and soybean) will be inoculated with cultures of isolated microbes individually or in combination and planted into soil. Alternatively, cultures of isolated microbes, individually or in combination, can be applied to the roots of the host plant by inoculating the soil directly over the roots. The colonization potential of the microbes will be assayed, for example, using a quantitative PCR (qPCR) method described in a greater detail below.

3. Assay the Microbe for Colonization of the Host Plant in Small-Scale Field Trials and Isolate RNA from Colonized Root Samples (CAT Trials)

Isolated microbes will be assessed for colonization of the desired host plant in small-scale field trials. Additionally, RNA will be isolated from colonized root samples to obtain transcriptome data for the strain in a field environment. These small-scale field trials are referred to herein as CAT (Colonization and Transcript) trials, as these trials provide Colonization and Transcript data for the strain in a field environment.

For these trials, seeds of the host plant (e.g., corn, wheat, rice, *sorghum*, and soybean) will be inoculated using cultures of isolated microbes individually or in combination and planted into soil. Alternatively, cultures of isolated microbes, individually or in combination, can be applied to the roots of the host plant by inoculating the soil directly over the roots. The CAT trials can be conducted in a variety of soils and/or under various temperature and/or moisture conditions to assess the colonization potential and obtain transcriptome profile of the microbe in various soil types and environmental conditions.

Colonization of roots of the host plant by the inoculated microbe(s) will be assessed, for example, using a qPCR method as described below.

In one protocol, the colonization potential of isolated microbes was assessed as follows. One day after planting of corn seeds, 1 ml of microbial overnight culture (SOB media) was drenched right at the spot of where the seed was located. 1 mL of this overnight culture was roughly equivalent to about 10^9 cfu, varying within 3-fold of each other, depending on which strain is being used. Each seedling was fertilized 3× weekly with 50 mL modified Hoagland's solution supplemented with either 2.5 mM or 0.25 mM ammonium nitrate. At four weeks after planting, root samples were collected for DNA extraction. Soil debris were washed away using pressurized water spray. These tissue samples were then homogenized using QIAGEN Tissuelyzer and the DNA was then extracted using QIAmp DNA Mini Kit (QIAGEN) according to the recommended protocol. qPCR assay was performed using Stratagene Mx3005P RT-PCR on these DNA extracts using primers that were designed (using NCBI's Primer BLAST) to be specific to a loci in each of the microbe's genome.

The presence of the genome copies of the microbe was quantified, which reflected the colonization potential of the microbe. Identity of the microbial species was confirmed by sequencing the PCR amplification products.

Additionally, RNA will be isolated from colonized root and/or soil samples and sequenced.

Unlike the DNA profile, an RNA profile varies depending on the environmental conditions. Therefore, sequencing of RNA isolated from colonized roots and/or soil will reflect the transcriptional activity of genes in planta in the rhizosphere.

RNA can be isolated from colonized root and/or soil samples at different time points to analyze the changes in the RNA profile of the colonized microbe at these time points.

For example, RNA can be isolated from colonized root and/or soil samples right after fertilization of the field and a few weeks after fertilization of the field and sequenced to generate corresponding transcriptional profile.

Similarly, RNA sequencing can be carried out under high phosphate and low phosphate conditions to understand which genes are transcriptionally active or repressed under these conditions.

Methods for transcriptomic/RNA sequencing are known in the art. Briefly, total RNA will be isolated from the purified culture of the isolated microbe; cDNA will be prepared using reverse transcriptase; and the cDNA will be sequenced using high throughput sequencing tools described above.

Sequencing reads from the transcriptome analysis can be mapped to the genomic sequence and transcriptional promoters for the genes of interest can be identified.

4. Assay the Plant-Beneficial Activity of Isolated Microbes

The plant-beneficial activity of isolated microbes will be assessed.

For example, nitrogen fixing microbes will be assayed for nitrogen fixation activity using an acetylene reduction assay (ARA) or phosphate solubilizing microbes will be assayed for phosphate solubilization. Any parameter of interest can be utilized and an appropriate assay developed for such. For instance, assays could include growth curves for colonization metrics and assays for production of phytohormones like indole acetic acid (IAA) or gibberellins. An assay for any plant-beneficial activity that is of interest can be developed.

This step will confirm the phenotype of interest and eliminate any false positives.

5. Selection of Potential Candidates from Isolated Microbes

The data generated in the above steps will be used to select microbes for further development. For example, microbes showing a desired combination of colonization potential, plant-beneficial activity, and/or relevant DNA and RNA profile will be selected for domestication and remodeling.

C. Domestication of Selected Microbes

The selected microbes will be domesticated; wherein, the microbes will be converted to a form that is genetically tractable and identifiable.

1. Test for Antibiotic Sensitivity

One way to domesticate the microbes is to engineer them with antibiotic resistance. For this, the wild type microbial strain will be tested for sensitivity to various antibiotics. If the strain is sensitive to the antibiotic, then the antibiotic can be a good candidate for use in genetic tools/vectors for remodeling the strain.

2. Design and Build a Vector

Vectors that are conditional for their replication (e.g. a suicide plasmid) will be constructed to domesticate the selected microbes (host microbes). For example, a suicide plasmid containing an appropriate antibiotic resistance marker, a counter selectable marker, an origin of replication for maintenance in a donor microbe (e.g. E. coli), a gene encoding a fluorescent protein (GFP, RFP, YFP, CFP, and the like) to screen for insertion through fluorescence, an origin of transfer for conjugation into the host microbe, and a polynucleotide sequence comprising homology arms to the host genome with a desired genetic variation will be constructed. The vector may comprise a SceI site and other additional elements.

Exemplary antibiotic resistance markers include ampicillin resistance marker, kanamycin resistance marker, tetracycline resistance marker, chloramphenicol resistance marker, erythromycin resistance marker, streptomycin resistance marker, spectinomycin resistance marker, etc. Exemplary counter selectable markers include sacB, rpsL, tetAR, pheS, thy A, lacY, gata-1, ccdB, etc.

3. Generation of Donor Microbes

In one protocol, a suicide plasmid containing an appropriate antibiotic resistance marker, a counter selectable marker, the Apir origin of replication for maintenance in E. coli ST18 containing the pir replication initiator gene, a gene encoding green fluorescent protein (GFP) to screen for insertion through fluorescence, an origin of transfer for conjugation into the host microbe, and a polynucleotide sequence comprising homology arms to the host genome with a desired genetic variation (e.g. a promoter from within the microbe's own genome for insertion into a heterologous location) will be transformed into E. coli ST18 (an auxotroph for aminolevulinic acid, ALA) to generate donor microbes.

4. Mix Donor Microbes with Host Microbes

Donor microbes will be mixed with host microbes (selected candidate microbes from step B5) to allow conjugative integration of the plasmid into the host genome. The mixture of donor and host microbes will be plated on a medium containing the antibiotic and not containing ALA. The suicide plasmid is able to replicate in donor microbes (*E. coli* ST18), but not in the host. Therefore, when the mixture containing donor and host microbes is plated on a medium containing the antibiotic and not containing ALA, only host cells that integrated the plasmid into its genome will be able to grow and form colonies on the medium. The donor microbes will not grow due to the absence of ALA.

5. Confirm Integration of the Vector

A proper integration of the suicide plasmid containing the fluorescent protein marker, the antibiotic resistance marker, the counter selectable marker, etc. at the intended locus of the host microbe will be confirmed through fluorescence of colonies on the plate and using colony PCR.

6. Streak Confirm Integration Colony

A second round of homologous recombination in the host microbes will loop out (remove) the plasmid backbone leaving the desired genetic variation (e.g. a promoter from within the microbe's own genome for insertion into a heterologous location) integrated into the host genome of a certain percentage of host microbes, while reverting a certain percentage back to wild type.

Colonies of host microbes that have looped out the plasmid backbone (and therefore, looped out the counter selectable marker) can be selected by growing them on an appropriate medium.

For example, if sacB is used as a counter selectable marker, loss of this marker due to the loss of the plasmid backbone will be tested by growing the colonies on a medium containing sucrose (sacB confers sensitivity to sucrose). Colonies that grow on this medium would have lost the sacB marker and the plasmid backbone and would either contain the desired genetic variation or be reverted to wild type. Also, these colonies will not fluoresce on the plate due to the loss of the fluorescent protein marker.

In some isolates, the sacB or other counterselectable markers do not confer full sensitivity to sucrose or other counterselection mechanisms, which necessitates screening large numbers of colonies to isolate a successful loop-out. In those cases, loop-out may be aided by use of a "helper plasmid" that replicates independently in the host cell and expresses a restriction endonuclease, e.g. SceI, which recognizes a site in the integrated suicide plasmid backbone. The strain with the integrated suicide plasmid is transformed with the helper plasmid containing an antibiotic resistance marker, an origin of replication compatible with the host strain, and a gene encoding a restriction endonuclease controlled by a constitutive or inducible promoter. The double-strand break induced in the integrated plasmid backbone by the restriction endonuclease promotes homologous recombination to loop-out the suicide plasmid. This increases the number of looped-out colonies on the counterselection plate and decreases the number of colonies that need to be screened to find a colony containing the desired mutation. The helper plasmid is then removed from the strain by culture and serial passaging in the absence of antibiotic selection for the plasmid. The passaged cultures are streaked for single colonies, colonies are picked and screened for sensitivity to the antibiotic used for selection of the helper plasmid, as well as absence of the plasmid confirmed by colony PCR. Finally, the genome is sequenced and the absence of helper plasmid DNA is confirmed as described in D6.

7. Confirm Integration of the Genetic Variation Through Colony PCR

The colonies that grew better on the sucrose-containing medium (or other appropriate media depending on the counter selectable marked used) will be picked and the presence of the genetic variation at the intended locus will be confirmed by screening the colonies using colony PCR.

Although this example describes one protocol for domesticating the microbe and introducing genetic variation into the microbe, one of ordinary skill in the art would understand that the genetic variation can be introduced into the selected microbes using a variety of other techniques known in the art such as: polymerase chain reaction mutagenesis, oligonucleotide-directed mutagenesis, saturation mutagenesis, fragment shuffling mutagenesis, homologous recombination, ZFN, TALENS, CRISPR systems (Cas9, Cpf1, etc.), chemical mutagenesis, and combinations thereof.

8. Iterate Upon Steps C2-C7

If any of the steps C2-C7 fail to provide the intended outcome, the steps will be repeated to design an alternative vector that may comprise different elements for facilitating incorporation of desired genetic variations and markers into the host microbe.

9. Develop a Standard Operating Procedure (SOP)

Once the steps C2-C7 can be reproduced consistently for a given strain, the steps will be used to develop a standard operating procedure (SOP) for that strain and vector. This SOP can be used to improve other plant-beneficial traits of the microbe.

D. Non-Intergeneric Engineering Campaign and Optimization

1. Identify Gene Targets for Optimization

Selected microbes will be engineered/remodeled to improve performance of the plant-beneficial activity. For this, gene targets for improving the plant-beneficial activity will be identified.

Gene targets can be identified in various ways. For example, genes of interest can be identified while annotating the genes from the whole genome sequencing of isolated microbes. They can be identified through a literature search. For example, genes involved in nitrogen fixation are known in the literature. These known genes can be used as targets for introducing genetic variations. Gene targets can also be identified based on the RNA sequencing data obtained in the step B3 (small-scale field trials for colonization) or by performing RNA sequencing described in the step below.

2. Select Promoters for Promoter Swaps

A desired genetic variation for improving the plant-beneficial activity can comprise promoter swapping, in which the native promoter for a target gene is replaced with a stronger or weaker promoter (when compared to the native promoter) from within the microbe's genome, or differently regulated promoter (e.g. a N-independent). If the expression of a target gene increases the plant-beneficial activity (e.g., nifA, the expression of which enhances nitrogen fixation in microbes), the desired promoter for promoter swapping is a stronger promoter (compared to the native promoter of the target gene) that would further increase the expression level of the target gene compared to the native promoter. If the expression of a target gene decreases the plant-beneficial activity (e.g., nifL that downregulates nitrogen fixation), the desired promoter for promoter swapping is a weak promoter (compared to the native promoter of the target gene) that would substantially decrease the expression level of the target gene compared to the native promoter. Promoters can be inserted into genes to "knock-out" a gene's expression, while at the same time upregulating the expression of a downstream gene.

Promoters for promoter swapping can be selected based on the RNA sequencing data. For example, the RNA sequencing data can be used to identify strong and weak promoters, or constitutively active vs. inducible promoters.

For example, to identify strong and weak promoters, or constitutively active vs. inducible promoters, in the nitrogen fixation pathway, selected microbes will be cultured in vitro under nitrogen-depleted and nitrogen-replete conditions; RNA of the microbe will be isolated from these cultures; and sequenced.

In one protocol, the RNA profile of the microbe under nitrogen-depleted and nitrogen-replete conditions will be compared and active promoters with a desired transcription level will be identified. These promoters can be selected to swap a weak promoter.

Promoters can also be selected using the RNA sequencing data obtained in the step B3 that reflects the RNA profile of the microbe in planta in the host plant rhizosphere.

RNA sequencing under various conditions allows for selection of promoters that: a) are active in the rhizosphere during the host plant growth cycle in fertilized field conditions, and b) are also active in relevant in vitro conditions so they can be rapidly screened.

In an exemplary protocol, in planta RNA sequencing data from colonization assays (e.g. step B3) is used to measure the expression levels of genes in isolated microbes. In one embodiment, the level of gene expression is calculated as reads per kilobase per million mapped reads (RPKM). The expression level of various genes is compared to the expression level of a target gene and at least the top 10, 20, 30, 40, 50, 60, or 70 promoters, associated with the various genes, that show the highest or lowest level of expression compared to the target gene are selected as possible candidates for promoter swapping. Thus, one looks at expression levels of various genes relative to a target gene and then selects genes that demonstrate increased expression relative to a target (or standard) gene and then find the promoters associated with said genes.

For example, if the target gene is upregulation of nifA, the first 10, 20, 30, 40, 50, or 60 promoters for genes that show the highest level of expression compared to nifA are selected as possible candidates for promoter swapping.

These candidates can be further short-listed based on in vitro RNA sequencing data. For example, for nifA as the target gene, possible promoter candidates selected based on the in planta RNA sequencing data are further selected by choosing promoters with similar or increased gene expression levels compared to nifA under in vitro nitrogen-deplete vs. nitrogen-replete conditions.

The set of promoters selected in this step are used to swap the native promoter of the target gene (e.g. nifA). Remodeled strains with swapped promoters are tested in in vitro assays; strains with lower than expected activity are eliminated; and strains with expected or higher than expected activity are tested in field. The cycle of promoter selection may be repeated on remodeled strains to further improve their plant-beneficial activity.

Described here is an exemplary promoter swap experiment that was carried out based on in planta and in vitro RNA sequencing data from *Klebsiella variicola* strain, CI137 to improve the nitrogen fixation trait. CI137 was analyzed in ARA assays at 0 mM and 5 mM glutamine concentration and RNA was extracted from these ARA samples. The RNA was sequenced via NextSeq and a subset of reads from one sample was mapped to the CI137 genome (in vitro RNA sequencing data). RNA was extracted from the roots of corn plants at V5 stage in the colonization and activity assay (e.g. step B3) for CI137. Samples from 6 plants were pooled; the RNA from the pooled sample was sequenced using NextSeq, and reads were mapped to the CI137 genome (in planta RNA sequencing data). Out of $2 \times 10^8$ total reads, $7 \times 10^4$ reads mapped to CI137. In planta RNA sequencing data was used to rank genes in order of in planta expression levels and the expression levels were compared to the native nifA expression level. The first 40 promoters that showed the highest expression level (based on gene expression) compared to the native nifA expression level were selected. These 40 promoters were further short-listed based on the in vitro RNA sequencing data, where promoters with increased or similar in vitro expression levels compared to nifA were selected. The final list of promoters included 17 promoters and 2 versions of most promoters were used to generate promoter swap mutants; thus a total of 30 promoters were tested. Generation of a suite of CI137 mutants where nifL was deleted partially or completely and the 30 promoters inserted (ΔnifL::Prm) was attempted. 28 out of 30 mutants were generated successfully. The ΔnifL::Prm mutants were analyzed in ARA assays at 0 mM and 5 mM glutamine concentration and RNA was extracted from these ARA samples. Several mutants showed lower than expected or decreased ARA activity compared to the WT CI137 strain. A few mutants showed higher than expected ARA activity.

A person of ordinary skill in the art would appreciate from the above example that while in planta and/or in vitro RNA sequencing data can be used to select promoters for promoter swapping, the step of promoter selection is highly unpredictable and involves many challenges.

For example, in planta RNA sequencing mainly reveals the genes that are highly expressed; however, it is difficult to detect fine differences in gene expression and/or genes with low expression levels. For instance, in some in planta RNA sequencing experiments, only about 40 out of about 5000 genes from a microbial genome were detected. Thus, in planta RNA sequencing technique is useful to identify abundantly expressed genes and their corresponding promoters; however, the technique has difficulty in identifying low expression genes and corresponding promoters and small differences between gene expression.

Furthermore, in planta RNA profile reflects the status of the genes at the time the microbes were isolated; however, a slight change in the field conditions can substantially change the RNA profile of rhizosphere/epiphytic/endophytic microbes. Therefore, it is difficult to predict in advance whether the promoters selected based on one field trial RNA sequencing data would provide desirable expression levels of the target gene when remodeled strains are tested in vitro and in field.

Additionally, in planta evaluation is time and resource-consuming; therefore, in planta experiments cannot be conducted often and/or repeated quickly or easily. On the other hand, while in vitro RNA sequencing can be conducted relatively quickly and easily, the in vitro conditions do not mimic the field conditions and promoters that may show high activity in vitro may not show comparable activity in planta.

Moreover, promoters often don't behave as predicted in a new context. Therefore, in planta and in vitro RNA sequencing data can at best serve as a starting point in the step of promoter selection; however, arriving at any particular promoter that would provide desirable expression levels of the target gene in the field is, in some instances, unpredictable.

Another limitation in the step of promoter selection is the number of available promoters. Because one of the goals of the present invention is to provide non-transgenic microbes; promoters for promoter swapping need to be selected from within the microbe's genome, or genus. Thus, unlike a transgenic approach, the present process cannot merely go out into the literature and find/use a well-characterized transgenic promoter from a different host organism.

Another constraint is that the promoter must be active in planta during a desired growth phase. For example, the highest requirement for nitrogen in plants is generally late in the growing season, e.g. late vegetative and early reproductive phases. For example, in corn, nitrogen uptake is the highest during V6 (6 leaves) through R1 (reproductive stage 1) stages. Therefore, to increase the availability of nitrogen during V6 through R1 stages of corn, remodeled microbes must show highest nitrogen fixation activity during these stages of the corn lifecycle. Accordingly, promoters that are active in planta during the late vegetative and early reproductive stages of corn need to be selected. This constraint not only reduces the number of promoters that may be tested in promoter swapping, but also make the step of promoter selection unpredictable. As discussed above, unpredictability arises, in part, because although the RNA sequencing data from small scale field trials (e.g. step B3) may be used to identify promoters that are active in planta during a desired growth stage, the RNA data is based on the field conditions (e.g., type of soil, level of water in the soil, level of available nitrogen, etc.) at the time of sample collection. As one of ordinary skill in the art would understand, the field conditions may change over the period of time within the same field and also change substantially across various fields. Thus, the promoters selected under one field condition may not behave as expected under other field conditions. Similarly, selected promoters may not behave as expected after swapping. Therefore, it is difficult to anticipate in advance whether the selected promoters would be active in planta during a desired growth phase of a plant of interest.

3. Design Non-Intergeneric Genetic Variations

Based on steps D1 (identification of gene targets) and D2 (identification of promoters for promoter swaps), non-intergeneric genetic variations will be designed.

The term "non-intergeneric" indicates that the genetic variation to be introduced into the host does not contain a nucleic acid sequence from outside the host genus (i.e., no transgenic DNA). Although vectors and/or other genetic tools will be used to introduce the genetic variation into the host microbe, the methods of the present disclosure include steps to loop-out (remove) the backbone vector sequences or other genetic tools introduced into the host microbe leaving only the desired genetic variation into the host genome. Thus, the resulting microbe is non-transgenic.

Exemplary non-intergeneric genetic variations include a mutation in the gene of interest that may improve the function of the protein encoded by the gene; a constitutionally active promoter that can replace the endogenous promoter of the gene of interest to increase the expression of the gene; a mutation that will inactivate the gene of interest; the insertion of a promoter from within the host's genome into a heterologous location, e.g. insertion of the promoter into a gene that results in inactivation of said gene and upregulation of a downstream gene; and the like. The mutations can be point mutations, insertions, and/or deletions (full or partial deletion of the gene). For example, in one protocol, to improve the nitrogen fixation activity of the host microbe, a desired genetic variation may comprise an inactivating mutation of the nifL gene (negative regulator of nitrogen fixation pathway) and/or comprise replacing the endogenous promoter of the nifH gene (nitrogenase iron protein that catalyzes a key reaction to fix atmospheric nitrogen) with a constitutionally active promoter that will drive the expression of the nifH gene constitutively.

4. Generate Non-Intergeneric Derivative Strains

After designing the non-intergeneric genetic variations, steps C2-C7 will be carried out to generate non-intergeneric derivative strains (i.e. remodeled microbes).

5. Bank a Purified Culture of the Remodeled Microbe

A purified culture of the remodeled microbe will be preserved in a bank, so that gDNA can be extracted for whole genome sequencing described below.

6. Confirm Presence of the Desired Genetic Variation

The genomic DNA of the remodeled microbe will be extracted and the whole genome sequencing will be performed on the genomic DNA using methods described previously. The resulting reads will be mapped to the reads previously stored in LIMS to confirm: a) presence of the desired genetic variation, and b) complete absence of reads mapping to vector sequences (e.g. plasmid backbone or helper plasmid sequence) that were used to generate the remodeled microbe.

This step allows sensitive detection of non-host genus DNA (transgenic DNA) that may remain in the strain after looping out of the vector backbone (e.g. suicide plasmid) method and could provide a control for accidental off-target insertion of the genetic variation, etc.

E. Analytics Upon Remodeled Microbes

1. Analysis of the Plant-Beneficial Activity

The plant-beneficial activity and growth kinetics of the remodeled microbes will be assessed in vitro.

For example, strains remodeled for improving nitrogen fixation function will be assessed for nitrogen fixation activity and fitness through acetylene reduction assays, ammonium excretion assays, etc.

Strains remodeled for improved phosphate solubilization will be assessed for the phosphate solubilization activity.

This step allows rapid, medium to high throughput screening of remodeled strains for the phenotypes of interest.

2. Analysis of Colonization and Transcription of the Altered Genes

Remodeled strains will be assessed for colonization of the host plant either in the greenhouse or in the field using the steps described in B3. Additionally, RNA will be isolated from colonized root and/or soil samples and sequenced to analyze the transcriptional activity of target genes. Target genes comprise the genes containing the genetic variation introduced and may also comprise other genes that play a role in the plant-beneficial trait of the microbe.

For example, a cluster of genes, the nif genes, controls the nitrogen fixation activity of microbes. Using the protocol described above, a genetic variation may be introduced into one of the nif genes (e.g. a promoter insertion), whereas the other genes in the nif cluster are in their endogenous form (i.e. their gene sequence and/or the promoter region is not altered). The RNA sequencing data will be analyzed for the transcriptional activity of the nif gene containing the genetic variation and may also be analyzed for other nif genes that are not altered directly, by the inserted genetic change, but nonetheless may be influenced by the introduced genetic change.

This step allows determination of the fitness of top in vitro performing strains in the rhizosphere and allows measurement of the transcriptional activity of altered genes in planta.

F. Iterate Engineering Campaign/Analytics

The data from in vitro and in planta analytics (steps E1 and E2) will be used to iteratively stack beneficial mutations.

Furthermore, steps A-E described above may be repeated to fine-tune the plant-beneficial traits of the microbes. For example, plants will be inoculated using microbial strains remodeled in the first round; harvested after a few weeks of growth; and microbes from the soil and/or roots of the plants will be isolated. The functional activity (plant-beneficial trait and colonization potential) and the DNA and RNA profile of isolated microbes will be characterized, in order to select microbes with improved plant-beneficial activity and colonization potential. The selected microbes will be remodeled to further improve the plant-beneficial activity. Remodeled microbes will be screened for the functional activity (plant-beneficial trait and colonization potential) and RNA profile in vitro and in planta and the top performing strains will be selected. If desired, steps A-E can be repeated to further improve the plant-beneficial activity of the remodeled microbes from the second round. The process can be repeated for 1, 2, 3, 4, 5, 6, 7, 8, 9, 10, or more rounds.

The exemplary steps described above are summarized in Table A below.

TABLE A

An Overview of an Embodiment of the Guided Microbial Remodeling Platform

| | Steps | Contribution | Alternate Forms |
|---|---|---|---|
| A | Isolation | | |
| 1 | Obtain a soil sample | Provides WT soil microbes to be isolated | |
| 2 | Grow corn "bait plants" in soil sample | Allows selection of plant-beneficial microbes by rhizosphere | Wheat, sorghum, rice, millet, soybean, etc. |
| 3 | Harvest, clean and extract root sample and plate on nitrogen-free (specifically NfB) media | Down-select soil microbes to those that a) colonize the root and b) fix atmospheric nitrogen | Other nitrogen-free media, other selective or screening media (eg. for phosphate solubilization) |
| 4 | Pick colonies, purify cultures and screen for presence of nifH using degenerate primers | Down-select microbes to those containing the nifH gene (eliminate false-positive from media screen) | Degenerate primers for other genes of interest, e.g. ipdC (phytohormone biosynthesis) |
| 5 | Bank a purified culture of the strain | | |
| B | Characterization | | |
| 1 | Sequence and assemble the genome of the strain using Illumina and/or PacBio platform | Characterize genome for key pathways | |
| 2 | Assay the microbe for colonization of corn roots in the greenhouse (qPCR-based method) | Down-select for microbes that colonize the plant well | Wheat, sorghum, rice, millet, soybean, etc., other methods for assaying colonization (e.g. plating) |
| 3 | Assay the microbe for colonization of com roots in a small-scale field trials (qPCR-based method) and isolate RNA from colonized root samples | Known internally as "CAT" trials, these provide Colonization And Transcript data for the strain in a field environment | Larger field trials, other crops, other methods for assaying colonization (e.g. plating) |
| 4 | Assay the microbe for nitrogen fixation activity in an acetylene reduction assay (ARA) | Confirm N-fixation phenotype of strain | |
| 5 | Use the above data to select candidate microbe for further domestication and optimization | Allows selection of greatest-potential candidates | |
| C | Domestication | | |
| 1 | Test microbes for sensitivity to various antibiotics | Determine which antibiotic selection markers can be used to transform genetic tools | |
| 2 | Design and build a suicide plasmid containing an appropriate antibiotic resistance marker, sacB counter-selectable marker, origin of replication for maintenance in *E. coli*, GFP to screen for insertion through | These are the "parts" necessary to maintain the plasmid and carry out conjugation, insertion and "loop-out" of the host genome | Plasmid could contain a SceI site or other counter-selectable marker, alternate fluorescent reporters, additional elements |

TABLE A-continued

An Overview of an Embodiment of the Guided Microbial Remodeling Platform

| | Steps | Contribution | Alternate Forms |
|---|---|---|---|
| | fluorescence, origin of transfer for conjugation into the host, homology arms to the host genome, and the desired mutation. | | |
| 3 | Transform suicide plasmid into *E. coli* ST18 (an auxotroph for aminolevulinic acid, ALA) to generate donor cells | Preparation for conjugation into host; plasmid maintenance | Could use a different donor strain of *E. coli* or other microbe; different auxotrophic marker |
| 4 | Mix donor cells with recipient host cells to conjugate, and plate on media selecting for the antibiotic resistance marker and NOT containing ALA | The suicide plasmid is able to replicate in *E. coli* but not in the host Therefore plating of the mixture on such plates means that only host cells that received the plasmid and experience plasmid integration into the chromosome will be able to grow and form colonies. The *E coli* ST18 is unable to grow due to the absence of ALA | Could use a different donor strain of *E. coli* or other microbe; different auxotrophic marker |
| 5 | Confirm integration of the plasmid through GFP fluorescence, and integration at the intended locus through colony PCR | Confirms proper integration of the suicide plasmid backbone containing GFP, the antibiotic resistance cassette, the sacB marker, etc. | |
| 6 | Streak confirmed integration colony on a plate containing sucrose and screen for non-fluorescent colonies | The sacB marker confers sensitivity to sucrose; colonies which have undergone a second round of homologous recombination and "looped-out" the plasmid will grow better and not fluoresce on the plate. | Different counter selectable marker, SceI-mediated loop-out, etc. |
| 7 | Screen looped-out colonies for the intended mutation using colony PCR | Upon the second homologous recombination event only 50% of looped out colonies should contain the mutation, the other 50% will be WT | |
| 8 | If any of the steps 2-7 fail, go back to step 2 and re-design with alternate plasmid parts | Allows iterative troubleshooting of suicide plasmid to develop a working protocol | |
| 9 | Once steps 2-7 can be reliably performed, develop an SOP for that strain/plasmid to be used for Optimization | | |
| D | Non-Intergeneric Engineering Campaign and Optimization | | |
| 1 | Identify gene targets for optimizing a pathway, eg. nif genes through literature search | | |
| 2 | Select promoters for promoter swaps using RNAseq data collected both in vitro in N-depleted and N-replete conditions, | Allows for selection of promoters that a) are active in the rhizosphere during the corn growth cycle in fertilized field conditions b) are also active in in vitro N- | Alternate crops; alternate RNAseq data conditions (greenhouse, field, in vitro, whatever's relevant for the phenotype targeted) |

TABLE A-continued

An Overview of an Embodiment of the Guided Microbial Remodeling Platform

| | Steps | Contribution | Alternate Forms |
|---|---|---|---|
| | and in planta from the corn rhizosphere (Collected in step B3) | replete conditions so they can be rapidly screened. | |
| 3 | Design non-intergeneric mutations in key genes: deletions (full or partial gene), promoter swaps, or single base pair changes; store these designs in our LIMS | No DNA from outside the host chromosome is added, therefore the resulting microbe is non-transgenic | Alter regulatory sequences (e.g. RBS), non-coding RNAs, etc. |
| 4 | Using the established protocol, carry out steps C2-7 to generate non-intergeneric derivative strains (mutants) | We perform this in higher throughput than the domestication step-up to 20 or so strains at once per person. | |
| 5 | Bank a purified culture of the strain, extract gDNA and conduct WGS via Illumina | | |
| 6 | Map the resulting reads to the designs stored in LIMS to confirm a) presence of the desire mutation and b) complete absence of reads mapping to any suicide plasmid or other plasmid sequences used to generate the strains | Allows very sensitive detection of non-intergeneric DNA that may remain in the strain after the suicide plasmid method; confirm absence of transgenic DNA, controls for accidental off-target insertion of the suicide plasmid, etc. | Suicide plasmid removal is fairly reliable; however use of other stable plasmids in alternate methods necessitates this extra step to ensure with complete confidence that no transgenic DNA that was previously transformed in remains in the strain. |
| E | Analytics | | |
| 1 | Analyze the strains for in vitro nitrogen fixation activity and fitness through ARA, ammonium excretion assays, and growth curves | Allow rapid, med- to high-throughput screening of mutants for phenotypes of interest | Any other in vitro assay, e.g. phosphate solubilization, qPCR for transcription of specific genes, etc. |
| 2 | Analyze the strains for colonization (qPCR) and transcription of target and promoter-swapped genes (Nanostring) in the plant (greenhouse or field) | Measure fitness of top in vitro performing strains in the rhizosphere; measure transcription of promoter-swapped genes in planta | |
| F | Iterate Engineering Campaign/Analytics | | |
| 1 | Use data from in vitro and in planta analytics to iteratively stack beneficial mutations. | | |

Figure 1C:
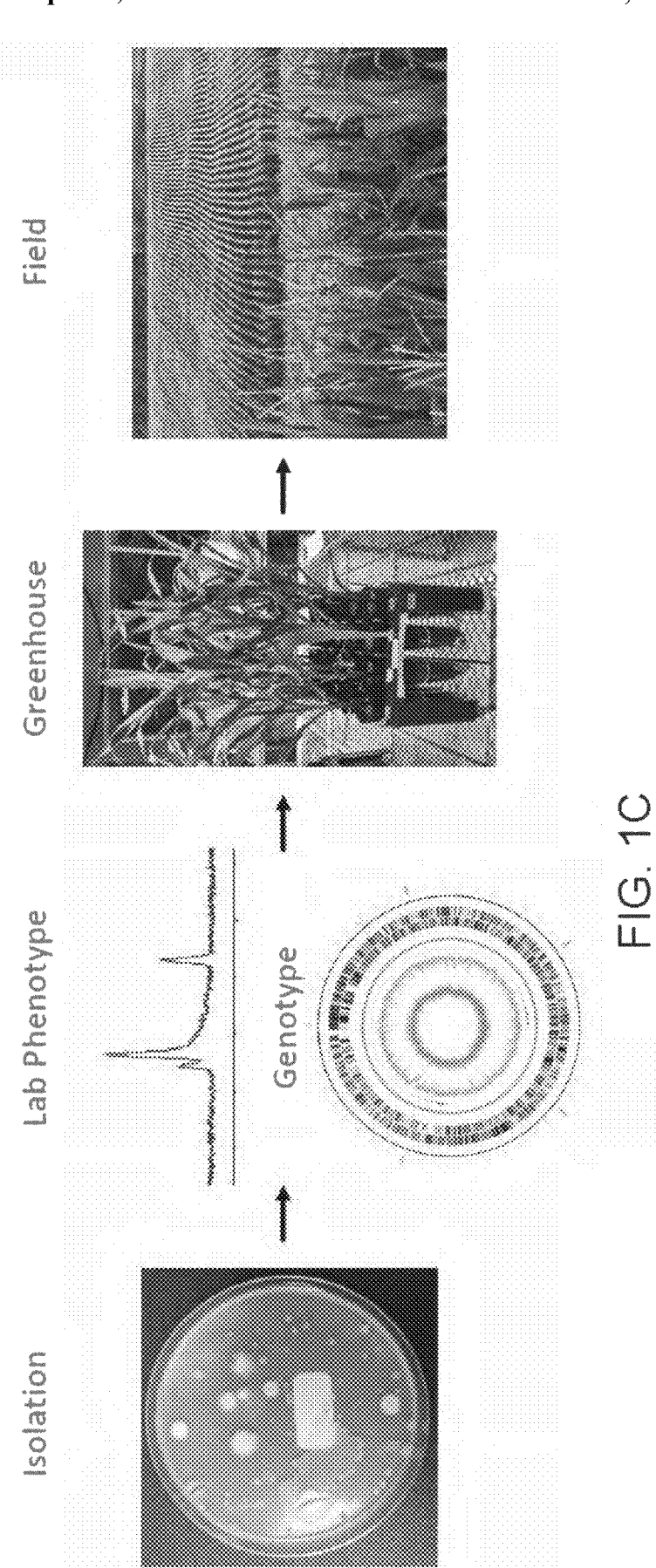
FIG. 1C depicts a problematic "traditional bioprospecting" approach, which has several drawbacks compared to the taught guided microbial remodeling (GMR) platform.

Traditional Approaches to Creating Biologicals for Agriculture Suffer from Drawbacks Inherent in their Methodology Unlike pure bioprospecting of wild type (WT) microbes or transgenic approaches, GMR allows for non-intergeneric genetic optimization of key regulatory networks within the microbe, which improves plant-beneficial phenotypes over WT microbes, but doesn't have the risks associated with transgenic approaches (e.g. unpredictable gene function, public and regulatory concerns). See, FIG. 1C for a depiction of a problematic "traditional bioprospecting" approach, which has several drawbacks compared to the taught GMR platform.

Figure 1D:
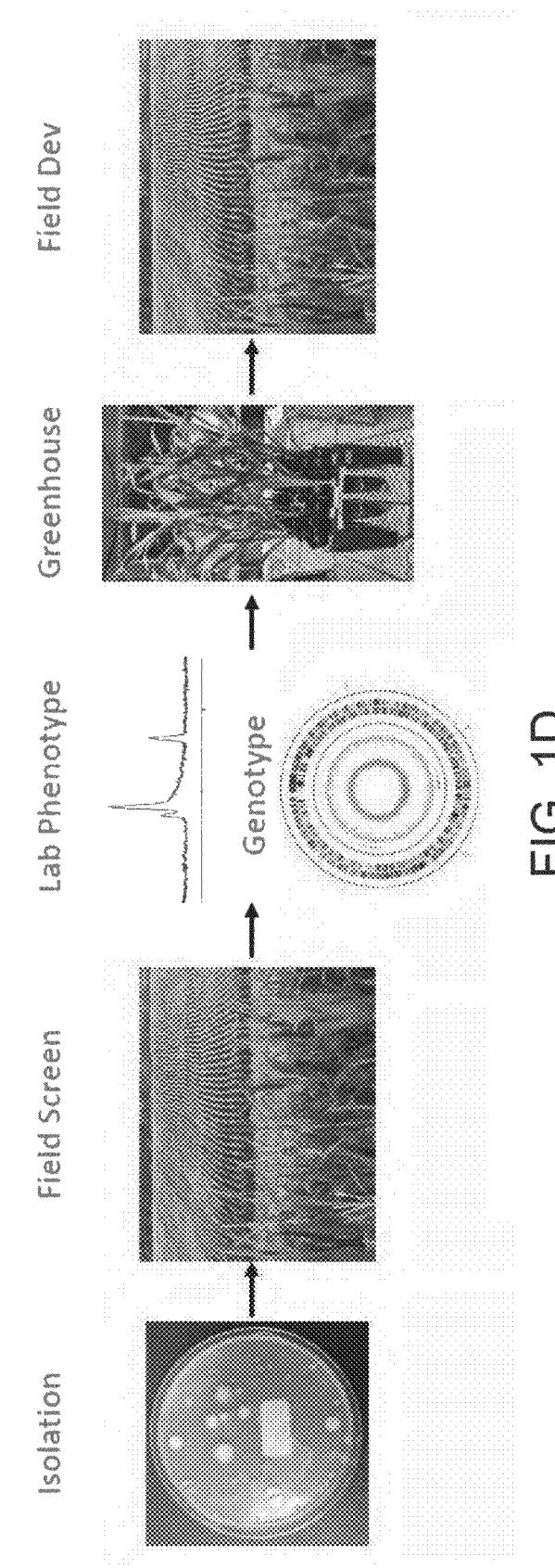
FIG. 1D depicts a problematic "field-first approach to bioprospecting" system, which has several drawbacks compared to the taught guided microbial remodeling (GMR) platform.

Other methods for developing microbials for agriculture are focused on either extensive lab development, which often fails at the field scale, or extensive greenhouse or "field-first" testing without an understanding of the underlying mechanisms/plant-microbe interactions. See, FIG. 1D for a depiction of a problematic "field-first approach to bioprospecting" system, which has several drawbacks compared to the taught GMR platform.

The GMR Platform Solves these Problems in Numerous Ways

One strength of the GMR platform is the identification of active promoters, which are active at key physiologically important times for a target crop, and which are also active under particular, agriculturally relevant, environmental conditions.

Figure 1E:
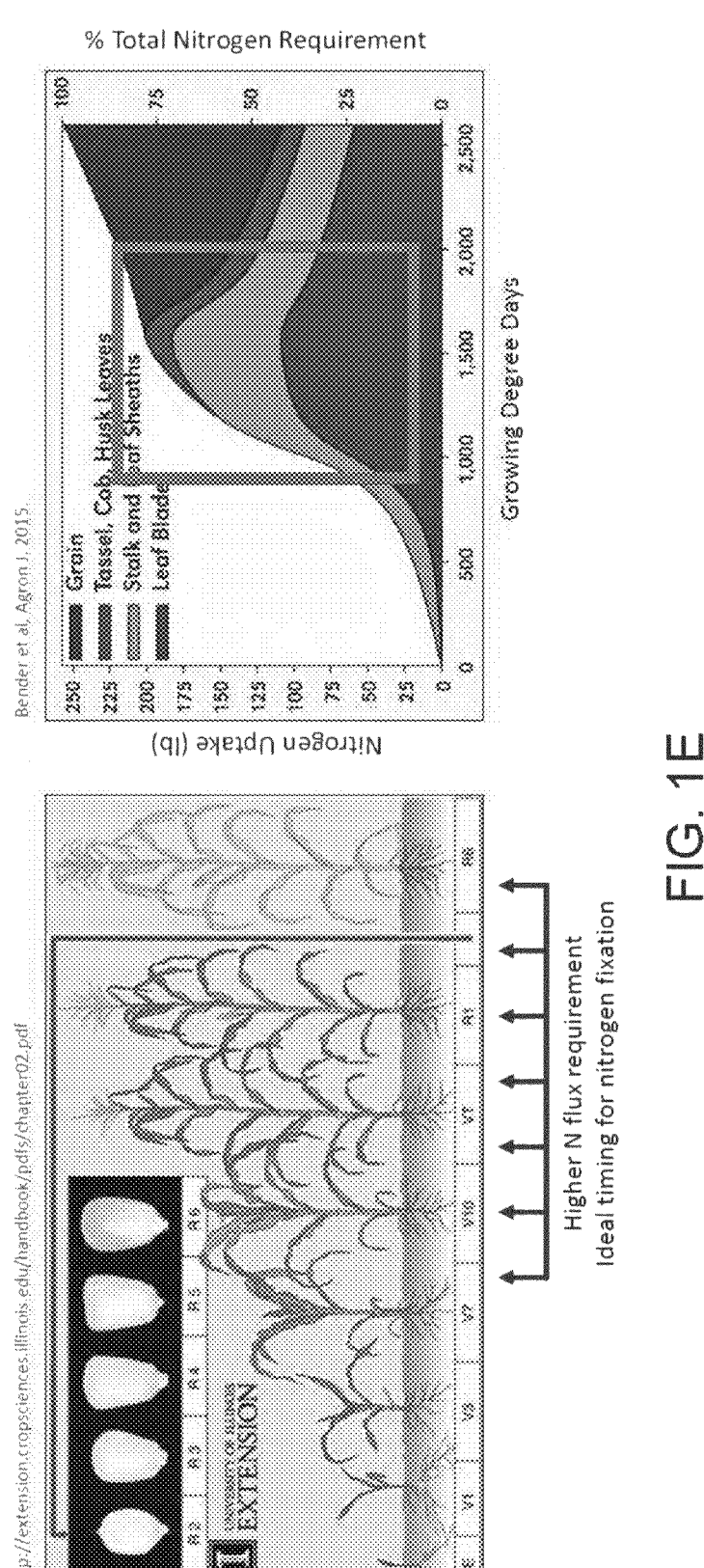
FIG. 1E depicts the time period in the corn growth cycle, at which nitrogen is needed most by the plant.
Figure 1F:
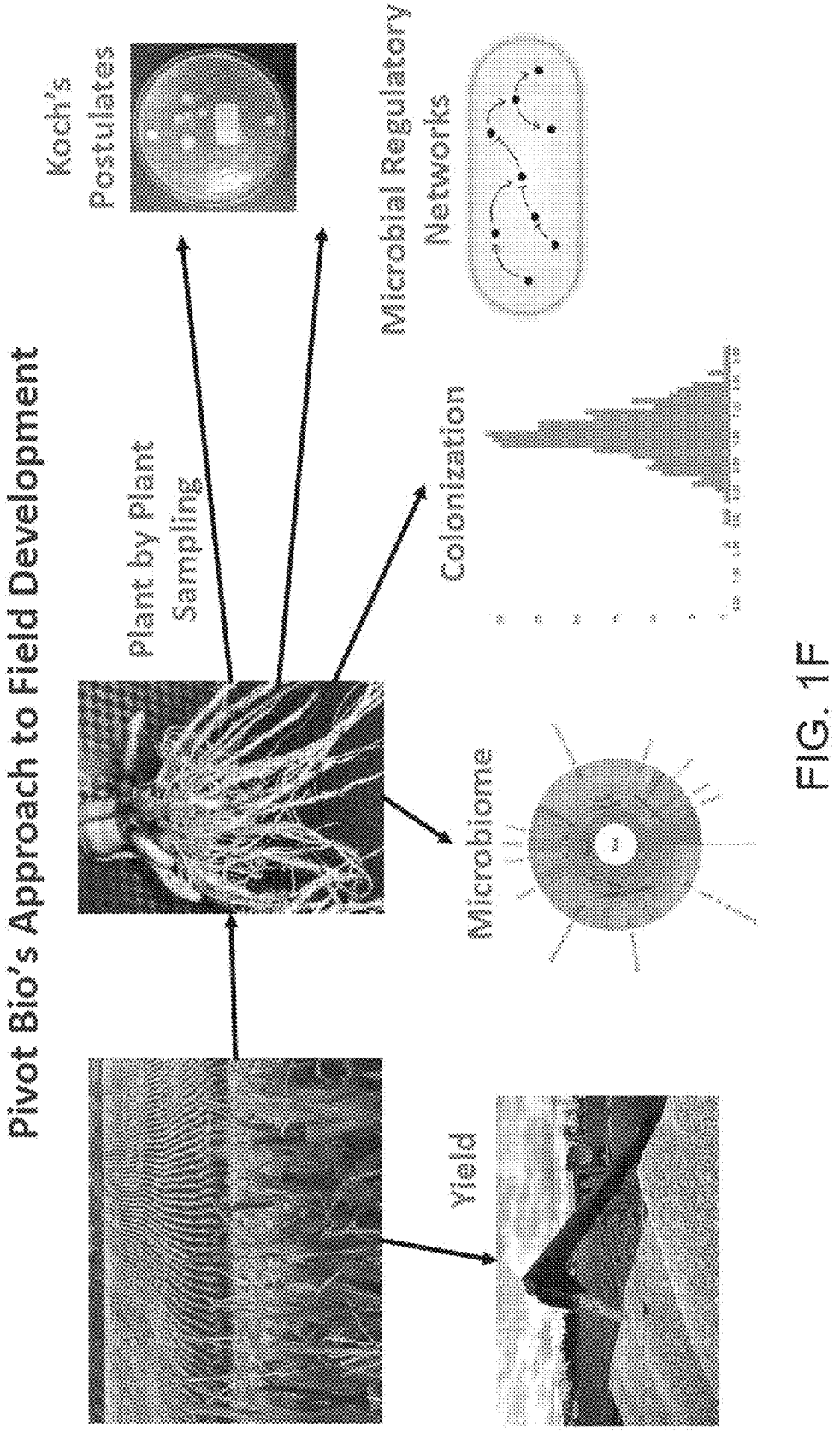
FIG. 1F depicts an overview of a field development process for a remodeled microbe.
Figure 1G:
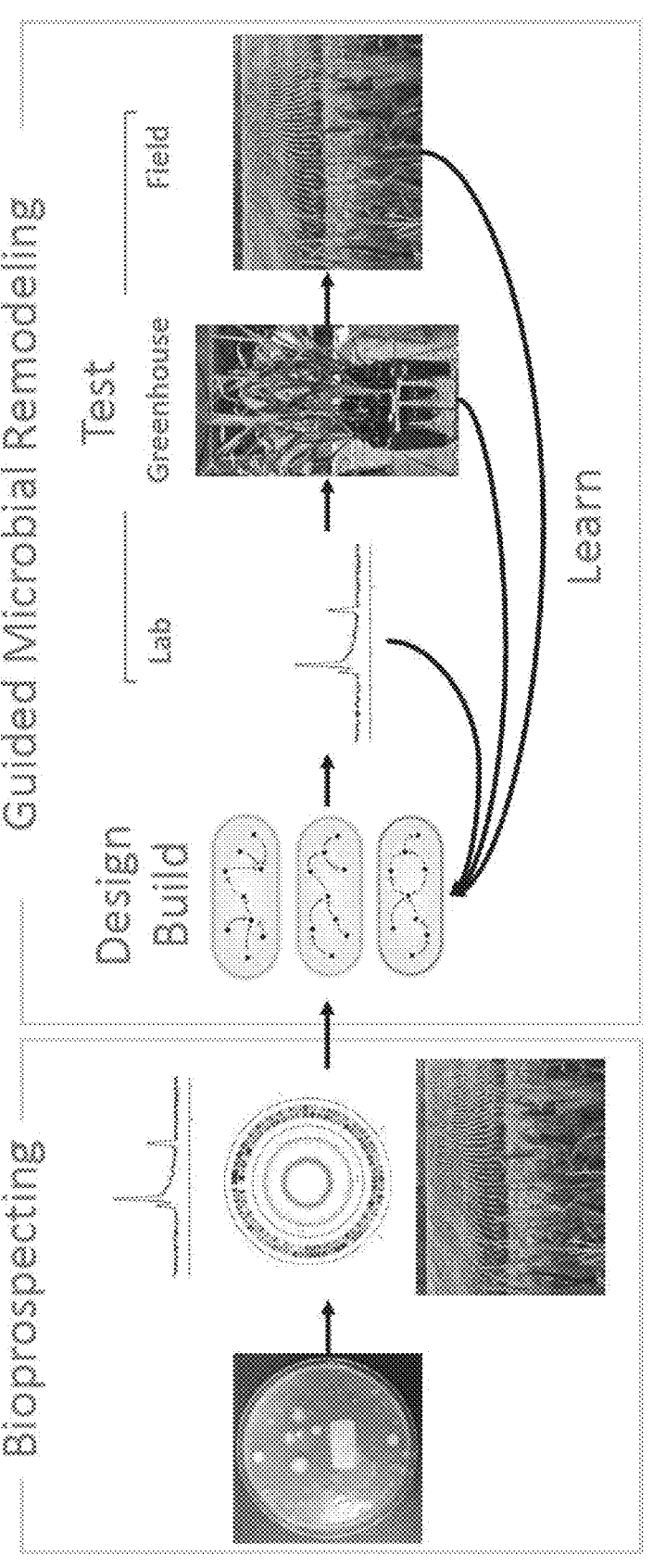
FIG. 1G depicts an overview of a guided microbial remodeling platform embodiment.
Figure 1H:
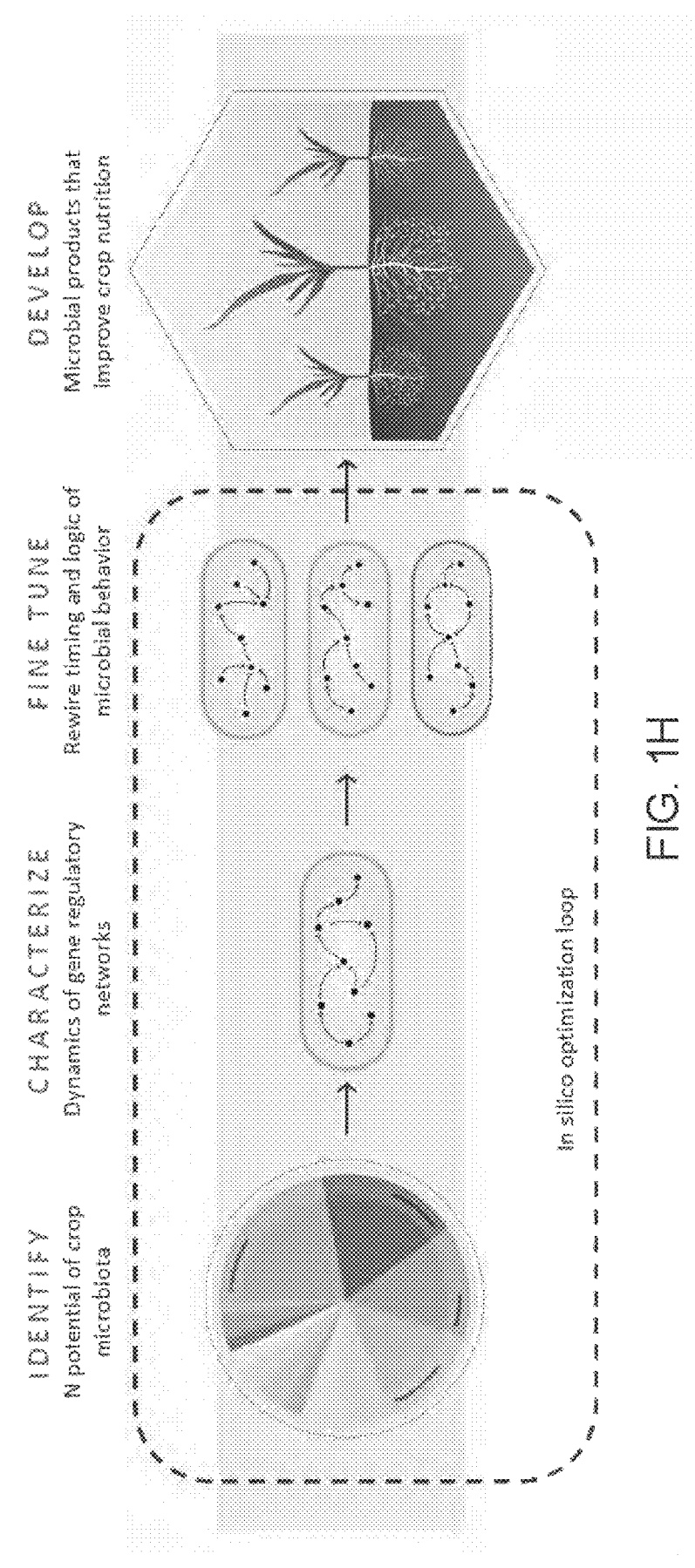
FIG. 1H depicts an overview of a computationally-guided microbial remodeling platform.
Figure 11:
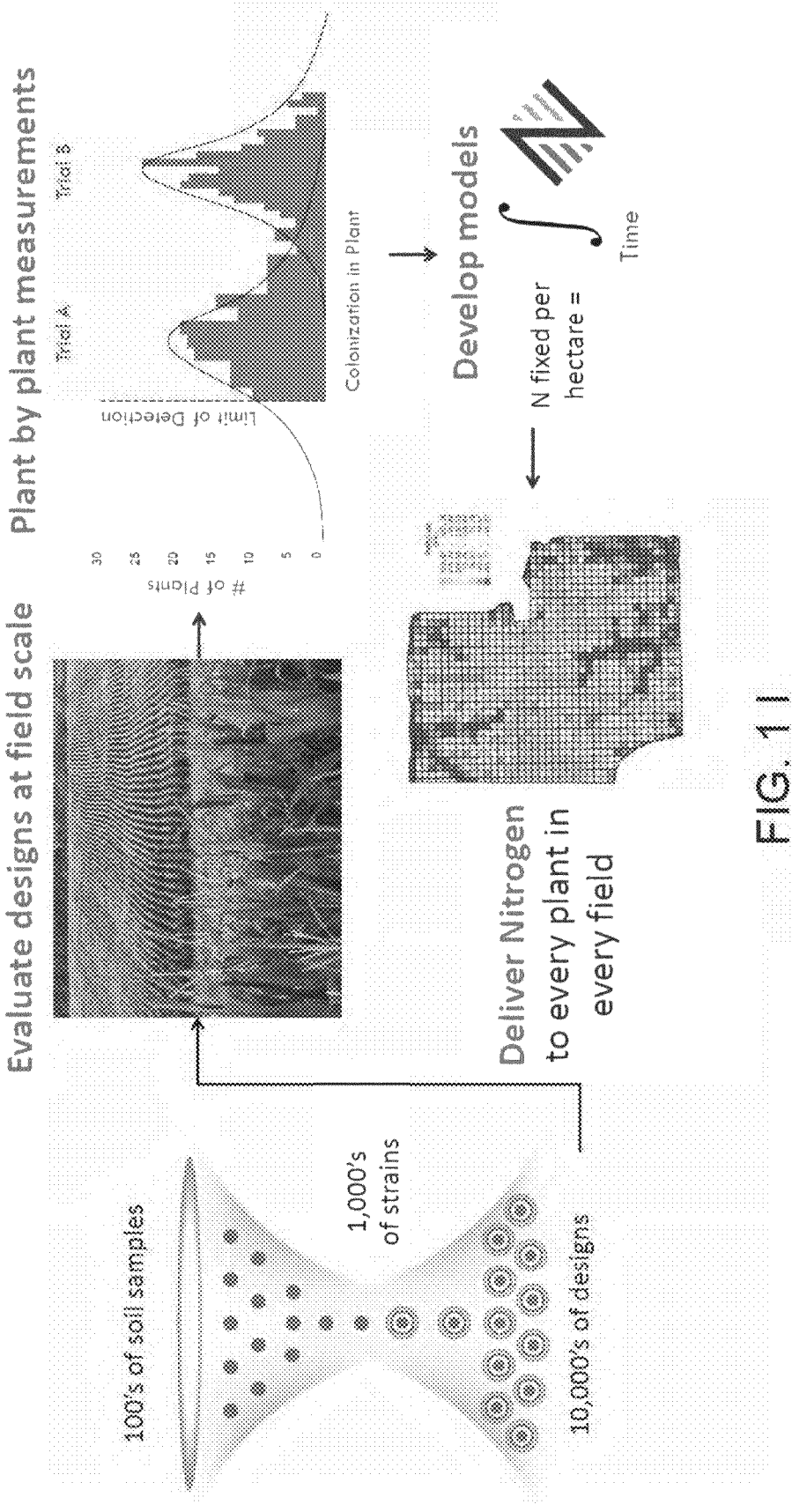
FIG. 11 depicts the plant yield of plants having been exposed to strain CM038. The area of the circles corresponds to the relative yield, while the shading corresponds to the particular MRTN treatment. The x-axis is the p value and the y-axis is the win rate.

As has been explained, within the context of nitrogen fixation, the GMR platform is able to identify microbial promoter sequences, which are active under environmental conditions of elevated exogenous nitrogen, which thereby allows the remodeled microbe to fix atmospheric nitrogen and deliver it to a target crop plant, under modern agricultural row crop conditions, and at a time when a plant needs the fixed nitrogen the most. See, FIG. 1E for a depiction of the time period in the corn growth cycle, at which nitrogen is needed most by the plant. The taught GMR platform is able to create remodeled microbes that supply nitrogen to a corn plant at the time period in which the nitrogen is needed, and also deliver such nitrogen even in the presence of exogenous nitrogen in the soil environment.

These promoters can be identified by rhizosphere RNA sequencing and read mapping to the microbe's genome sequence, and key pathways can be "reprogrammed" to be turned on or off during key stages of the plant growth cycle. Additionally, through whole genome sequencing of optimized microbes and mapping to previously-transformed sequences, the method has the ability to ensure that no transgenic sequences are accidentally released into the field through off-target insertion of plasmid DNA, low-level retention of plasmids not detected through PCR or antibiotic resistance, etc.

The GMR platform combines these approaches by evaluating microbes iteratively in the lab and plant environment, leading to microbes that are robust in greenhouse and field conditions rather than just in lab conditions.

Various aspects and embodiments of the taught GMR platform can be found in FIGS. 1F-1I. The GMR platform culminates in the derivation/creation/production of remodeled microbes that possess a plant-beneficial property, e.g. nitrogen fixation.

Figure 1J:
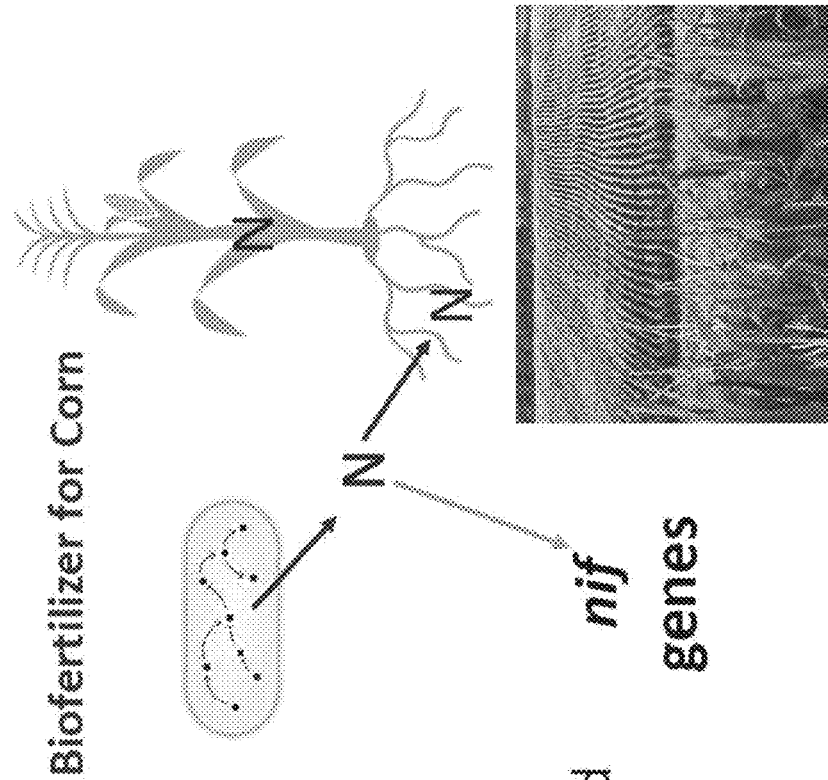
FIG. 1J depicts 5 properties that can be possessed by remodeled microbes of the present disclosure.

The traditional bioprospecting methods are not able to produce microbes having the aforementioned properties. Properties of a Microbe Remodeled for Nitrogen Fixation In the context of remodeling microbes for nitrogen fixation, there are several properties that the remodeled microbe may possess. For instance, FIG. 1J depicts 5 properties that can be possessed by remodeled microbes of the present disclosure.

Figure 1K:
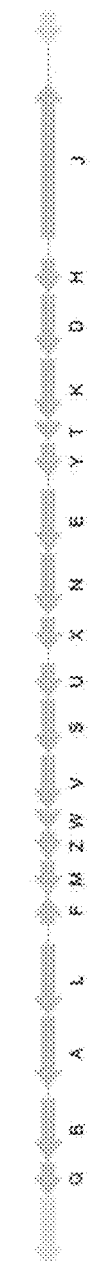
FIG. 1K depicts a schematic of a remodeling approach for a microbe, PBC6.1.
Figure 1K:
Figure 1K:
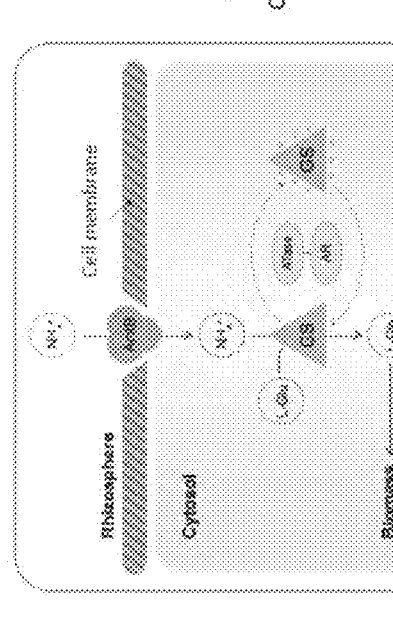
Figure 1L:
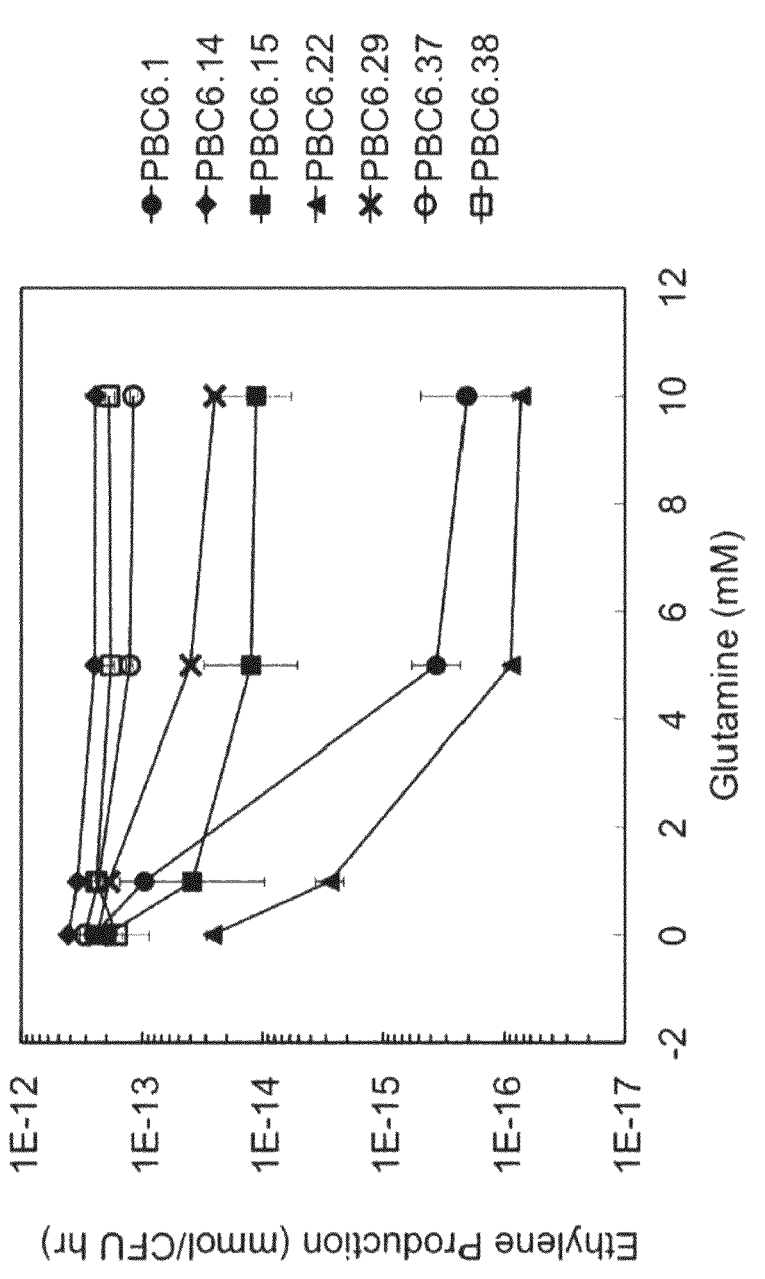
FIG. 1L depicts decoupled nifA expression from endogenous nitrogen regulation in remodeled microbes.
Figure 1M:
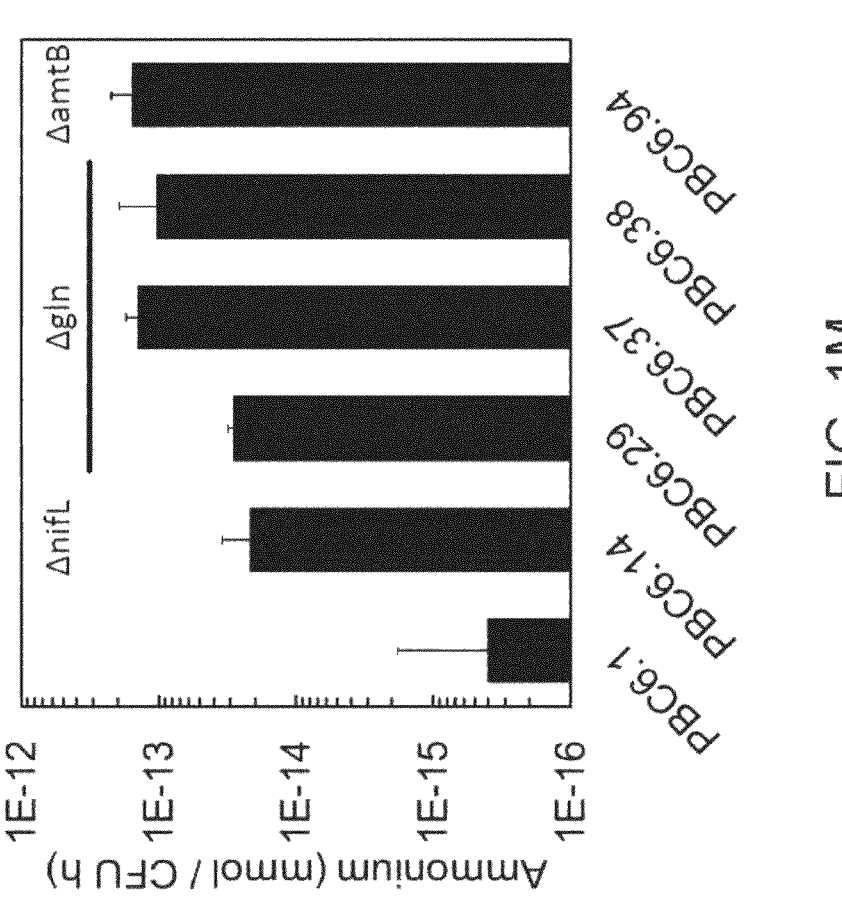
FIG. 1M depicts improved assimilation and excretion of fixed nitrogen by remodeled microbes.

Furthermore, as can be seen in Example 2, the present inventors have utilized the GMR platform to produce remodeled non-intergeneric bacteria (i.e. *Kosakonia sacchari*) capable of fixing atmospheric nitrogen and delivering said nitrogen to a corn plant, even under conditions in which exogenous nitrogen is present in the environment. See, FIG. 1K-M, which illustrate that the remodeling process successfully: (1) decoupled nifA expression from endogenous nitrogen regulation; and (2) improved the assimilation and excretion of fixed nitrogen.

Figure 1N:
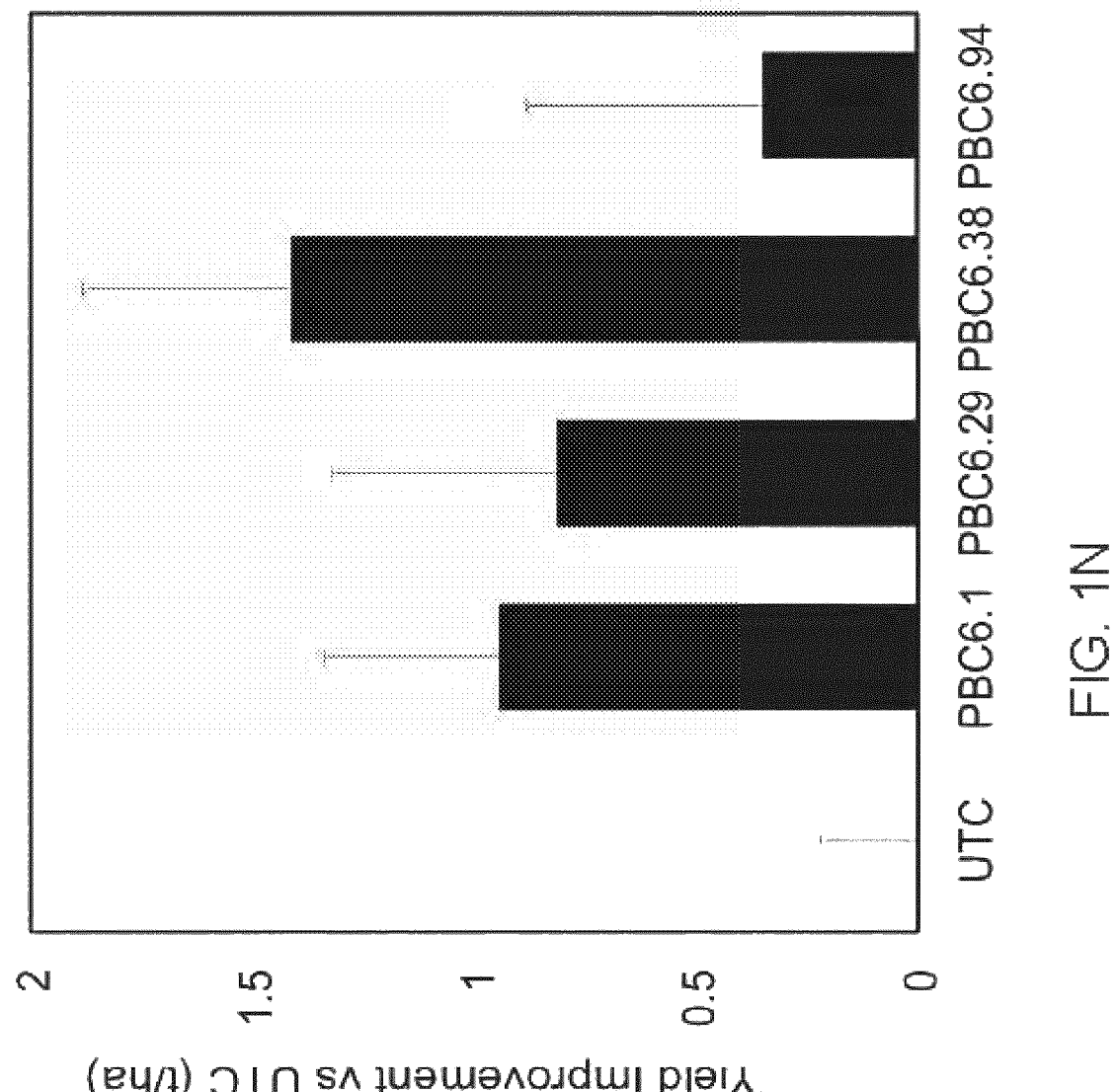
FIG. 1N depicts corn yield improvement attributable to remodeled microbes.
Figure 10:
FIG. 10 depicts the plant yield of plants having been exposed to strain CM029. The area of the circles corresponds to the relative yield, while the shading corresponds to the particular MRTN treatment. The x-axis is the p value and the y-axis is the win rate.
Figure 10:
Figure 10:
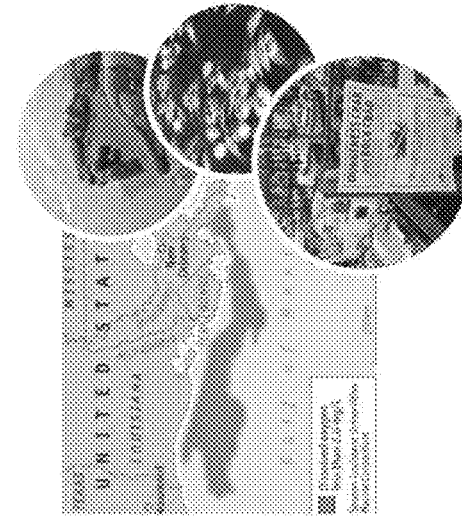
Figure 10:
Figure 10:
Figure 10:
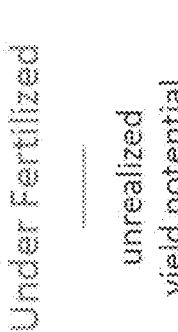
Figure 10:
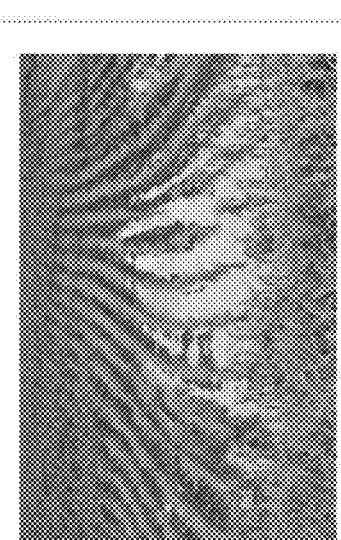

These remodeled microbes ultimately result in corn yield improvement, when applied to corn crops. See, FIG. 1N. The GMR Platform Provides an Approach to Nitrogen Fixation and Delivery that Solves Pressing Environmental Concerns As explained previously, the nitrogen fertilizer produced by the industrial Haber-Bosch process is not well utilized by the target crop. Rain, runoff, heat, volatilization, and the soil microbiome degrade the applied chemical fertilizer. This equates to not only wasted money, but also adds to increased pollution instead of harvested yield. To this end, the United Nations has calculated that nearly 80% of fertilizer is lost before a crop can utilize it. Consequently, modern agricultural fertilizer production and delivery is not only deleterious to the environment, but it is extremely inefficient. See, FIG. 1O, illustrating the inefficiency of current nitrogen delivery systems, which result in underfertilized fields, over fertilized fields, and environmentally deleterious nitrogen runoff.

The current GMR platform, and resulting remodeled microbes, provide a better approach to nitrogen fixation and delivery to plants. As will be seen in the below Examples, the non-intergeneric remodeled microbes of the disclosure are able to colonize the roots of a corn plant and spoon feed said corn plants with fixed atmospheric nitrogen, even in the presence of exogenous nitrogen. This system of nitrogen fixation and delivery-enabled by the taught GMR platform-will help transform modern agricultural to a more environmentally sustainable system.

Example 2: Guided Microbial Remodeling—An Example Embodiment for the Rational Improvement of Nitrogen Fixation A diversity of nitrogen fixing bacteria can be found in nature, including in agricultural soils. However, the potential of a microbe to provide sufficient nitrogen to crops to allow decreased fertilizer use may be limited by repression of nitrogenase genes in fertilized soils as well as low abundance in close association with crop roots. Identification, isolation and breeding of microbes that closely associate with key commercial crops might disrupt and improve the regulatory networks linking nitrogen sensing and nitrogen fixation and unlock significant nitrogen contributions by crop-associated microbes. To this end, nitrogen fixing microbes that associate with and colonize the root system of corn were identified. This step corresponds to the "Measure the Microbiome Composition" depicted in FIG. 1A and FIG. 1B.

Root samples from corn plants grown in agronomically relevant soils were collected, and microbial populations extracted from the rhizosphere and endosphere. Genomic DNA from these samples was extracted, followed by 16S amplicon sequencing to profile the community composition.

Figure 2:
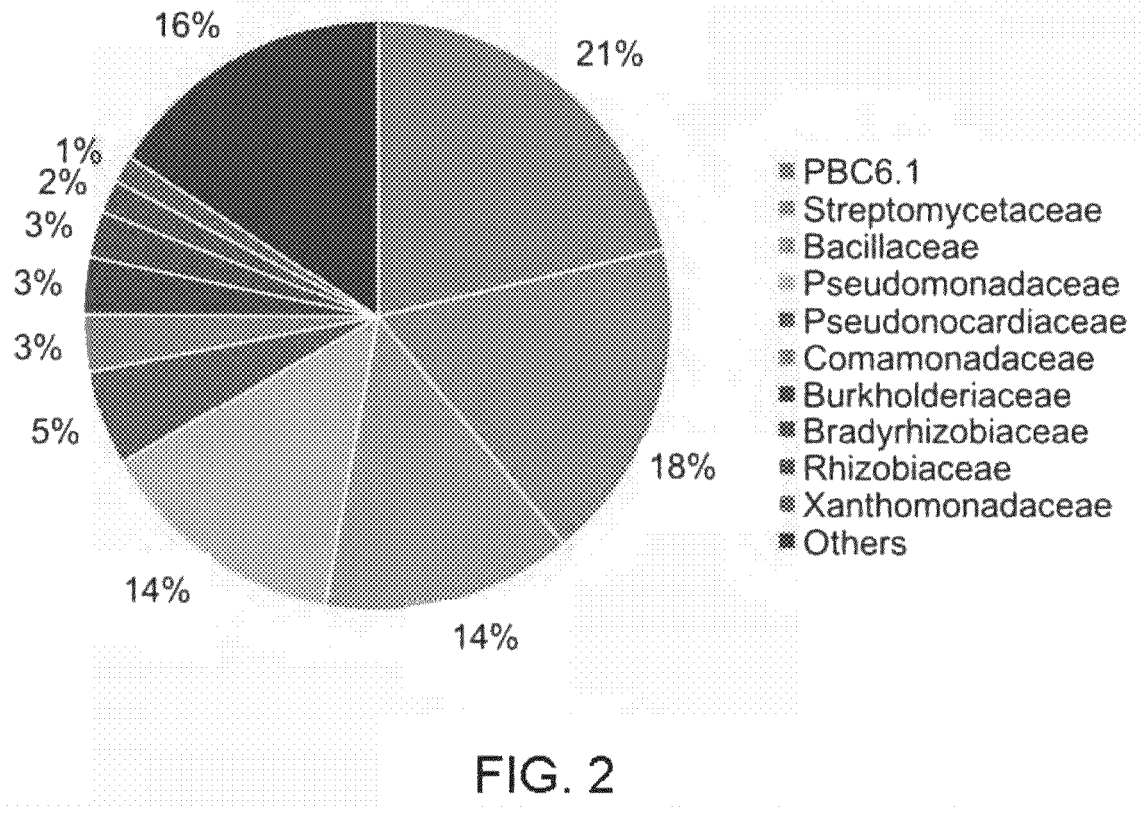
FIG. 2 illustrates PBC6.1 colonization to nearly 21% abundance of the root-associated microbiota in corn roots. Abundance data is based on 16S amplicon sequencing of the rhizosphere and endosphere of corn plants inoculated with PBC6.1 and grown in greenhouse conditions.

A *Kosakonia sacchari* microbe (strain PBC6.1) was isolated and classified through 16S rRNA and whole genome sequencing. This is a particularly interesting nitrogen fixer capable of colonizing to nearly 21% abundance of the root-associated microbiota (FIG. 2). To assess strain sensitivity to exogenous nitrogen, nitrogen fixation rates in pure culture were measured with the classical acetylene reduction assay (ARA) and varying levels of glutamine supplementation. The species exhibited a high level of nitrogen fixing activity in nitrogen-free media, yet exogenous fixed nitrogen repressed nif gene expression and nitrogenase activity (Strain PBC6.1, FIG. 3C, FIG. 3D). Additionally, when released ammonia was measured in the supernatant of PBC6.1 grown in nitrogen-fixing conditions, very little release of fixed nitrogen could be detected (FIG. 3E).

We hypothesized that PBC6.1 could be a significant contributor of fixed nitrogen in fertilized fields if regulatory networks controlling nitrogen metabolism were remodeled to allow optimal nitrogenase expression and ammonia release in the presence of fixed nitrogen.

Sufficient genetic diversity should exist within the PBC6.1 genome to enable broad phenotypic remodeling (as a result of remodeling the underlying genetic architecture in a non-intergeneric manner) without the insertion of transgenes or synthetic regulatory elements. The isolated strain has a genome of at least 5.4 Mbp and a canonical nitrogen fixation gene cluster. Related nitrogen metabolism pathways in PBC6.1 are similar to those of the model organism for nitrogen fixation, *Klebsiella oxytoca* m5al.

Figures 3A, 3B, 3C, 3D, 3E:
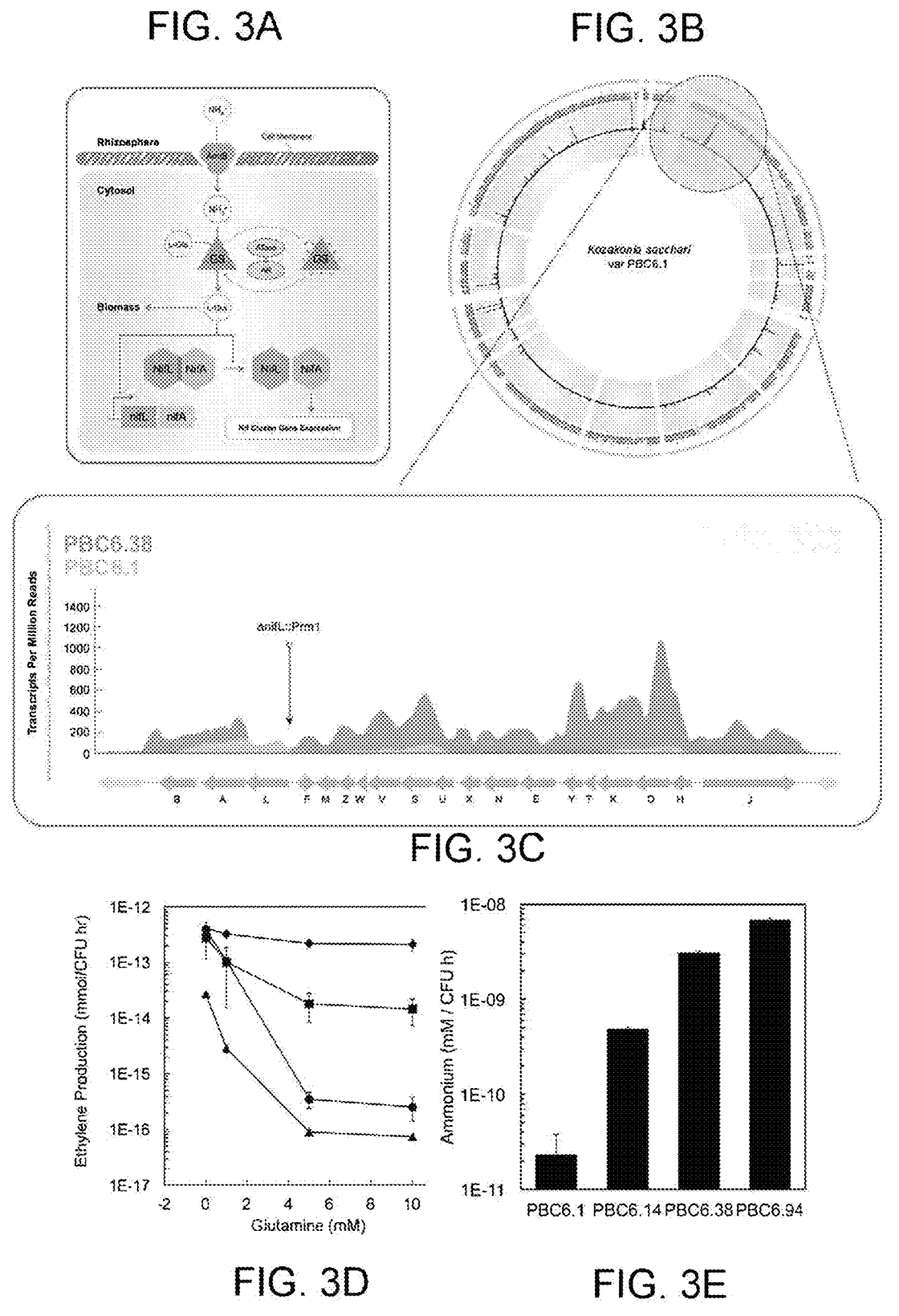

Several gene regulatory network nodes were identified which may augment nitrogen fixation and subsequent transfer to a host plant, particularly in high exogenous concentrations of fixed nitrogen (FIG. 3A). The nifLA operon directly regulates the rest of the nif cluster through transcriptional activation by NifA and nitrogen- and oxygen-dependent repression of NifA by NifL. Disruption of nifL can abolish inhibition of NifA and improve nif expression in the presence of both oxygen and exogenous fixed nitrogen. Furthermore, expressing nifA under the control of a nitrogen-independent promoter may decouple nitrogenase biosynthesis from regulation by the NtrB/NtrC nitrogen sensing complex.

The assimilation of fixed nitrogen by the microbe to glutamine by glutamine synthetase (GS) is reversibly regulated by the two-domain adenylyltransferase (ATase) enzyme GlnE through the adenylylation and deadenylylation of GS to attenuate and restore activity, respectively. Truncation of the GlnE protein to delete its adenylyl-removing (AR) domain may lead to constitutively adenylylated glutamine synthetase, limiting ammonia assimilation by the microbe and increasing intra- and extracellular ammonia.

Finally, reducing expression of AmtB, the transporter responsible for uptake of ammonia, could lead to greater extracellular ammonia.

To generate rationally designed microbial phenotypes without the use of transgenes, two approaches were employed to remodel the underlying genetic architecture of the microbe: (1) creating markerless deletions of genomic sequences encoding protein domains or whole genes, and (2) rewiring regulatory networks by intragenomic promoter rearrangement.

Through an iterative remodeling process, several non-transgenic derivative strains of PBC6.1 were generated (Table 25).

TABLE 25

List of isolated and derivative *K. sacchari* strains used in this work. Prm, promoter sequence derived from the PBC6.1 genome; ΔglnE$_{AR}$1 and ΔglnE$_{AR}$2, different truncated versions of glnE gene removing the adenylyl-removing domain sequence.

| Strain ID | Genotype |
|---|---|
| PBC6.1 | WT |
| PBC6.14 | ΔnifL::Prm1 |
| PBC6.15 | ΔnifL::Prm5 |
| PBC6.22 | ΔnifL::Prm3 |
| PBC6.37 | ΔnifL::Prm1 ΔglnE$_{AR}$2 |
| PBC6.38 | ΔnifL::Prm1 ΔglnE$_{AR}$1 |
| PBC6.93 | ΔnifL::Prm1 ΔglnE$_{AR}$2 ΔamtB |
| PBC6.94 | ΔnifL::Prm1 ΔglnE$_{AR}$1 ΔamtB |

Figure 4:
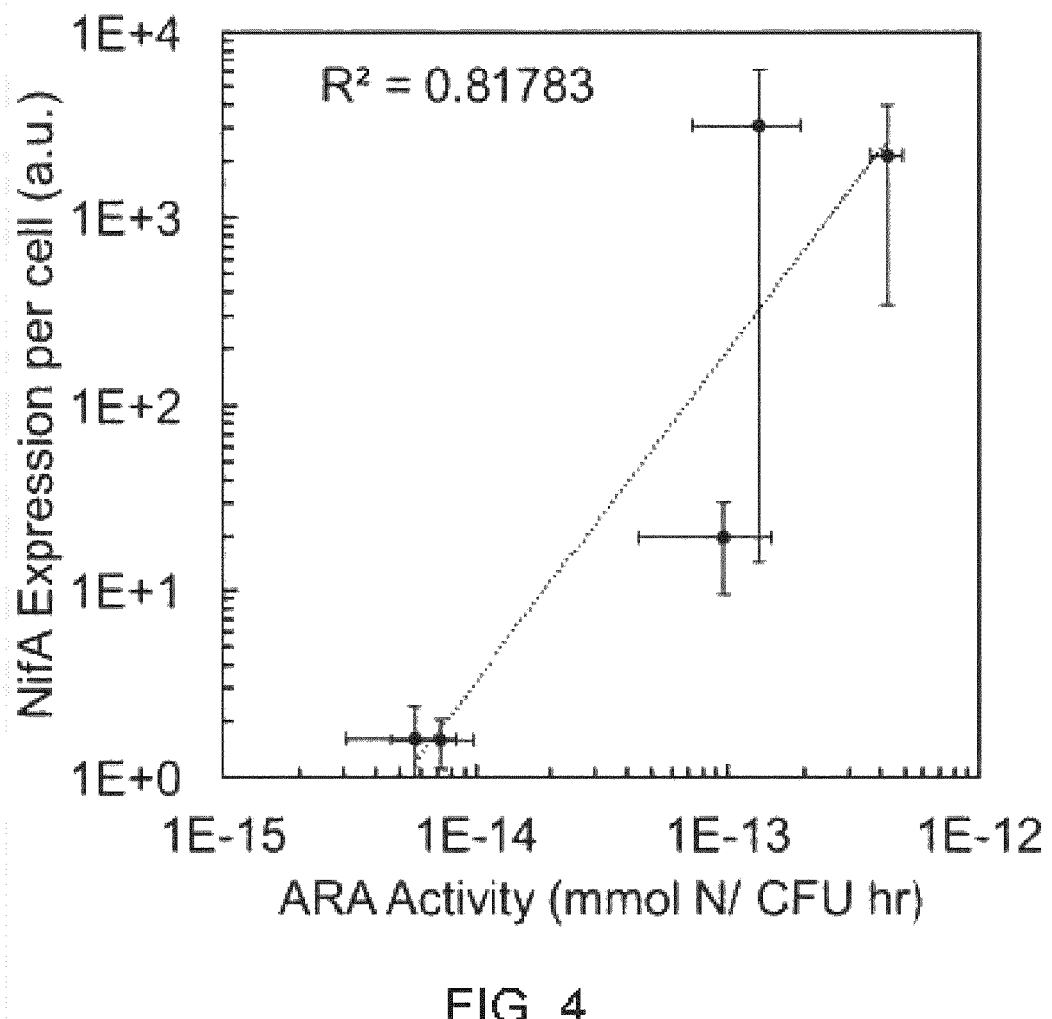
FIG. 4 illustrates transcriptional rates of nifA in derivative strains of PBC6.1 correlated with acetylene reduction rates. An ARA assay was performed as described in the Methods, after which cultures were sampled and subjected to qPCR analysis to determine nifA transcript levels. Error bars show standard error of the mean of at least three biological replicates in each measure.

Several in vitro assays were performed to characterize specific phenotypes of the derivative strains. The ARA was used to assess strain sensitivity to exogenous nitrogen, in which PBC6.1 exhibited repression of nitrogenase activity at high glutamine concentrations (FIG. 3D). In contrast, most derivative strains showed a derepressed phenotype with varying levels of acetylene reduction observed at high glutamine concentrations. Transcriptional rates of nifA in samples analyzed by qPCR correlated well with acetylene reduction rates (FIG. 4), supporting the hypothesis that nifL disruption and insertion of a nitrogen-independent promoter to drive nifA can lead to nif cluster derepression.

Strains with altered GlnE or AmtB activity showed markedly increased ammonium excretion rates compared to wild type or derivative strains without these mutations (FIG. 3E), illustrating the effect of these genotypes on ammonia assimilation and reuptake.

Two experiments were performed to study the interaction of PBC6.1 derivatives (remodeled microbes) with corn plants and quantify incorporation of fixed nitrogen into plant tissues. First, rates of microbial nitrogen fixation were quantified in a greenhouse study using isotopic tracers. Briefly, plants are grown with 15N labeled fertilizer, and diluted concentrations of 15N in plant tissues indicate contributions of fixed nitrogen from microbes. Corn seedlings were inoculated with selected microbial strains, and plants were grown to the V6 growth stage. Plants were subsequently deconstructed to enable measurement of microbial colonization and gene expression as well as measurement of 15N/14N ratios in plant tissues by isotope ratio mass spectrometry (IRMS). Analysis of the aerial tissue showed a small, nonsignificant contribution by PBC6.38 to plant nitrogen levels, and a significant contribution by PBC6.94 (p=0.011). Approximately 20% of the nitrogen found in above-ground corn leaves was produced by PBC6.94, with the remainder coming from the seed, potting mix, or "background" fixation by other soilborne microbes (FIG. 5C). This illustrates that our microbial breeding and remodeling pipeline can generate remodeled strains capable of making significant nitrogen contributions to plants in the presence of nitrogen fertilizer. Microbial transcription within plant tissues was measured, and expression of the nif gene cluster was observed in derivative remodeled strains, but not the wild type strain (FIG. 5B), showing the importance of nif derepression for contribution of BNF to crops in fertilized conditions. Root colonization measured by qPCR demonstrated that colonization density is different for each of the strains tested (FIG. 5A). A 50-fold difference in colonization was observed between PBC6.38 and PBC6.94. This difference could be an indication that PBC6.94 has reduced fitness in the rhizosphere relative to PBC6.38 as a result of high levels of fixation and excretion.

Methods

Media

Minimal medium contains (per liter) 25 g Na$_2$HPO$_4$, 0.1 g CaCL$_2$-2H$_2$O, 3 g KH$_2$PO$_4$, 0.25 g MgSO$_4$·7H$_2$O, 1 g NaCl, 2.9 mg FeCl$_3$, 0.25 mg Na$_2$MoO$_4$·2H$_2$O, and 20 g sucrose. Growth medium is defined as minimal medium supplemented with 50 ml of 200 mM glutamine per liter.

Isolation of Diazotrophs

Corn seedlings were grown from seed (DKC 66-40, DeKalb, IL) for two weeks in a greenhouse environment controlled from 22° C. (night) to 26° C. (day) and exposed to 16 hour light cycles in soil collected from San Joaquin County, CA. Roots were harvested and washed with sterile deionized water to remove bulk soil. Root tissues were homogenized with 2 mm stainless steel beads in a tissue lyser (TissueLyser II, Qiagen P/N 85300) for three minutes at setting 30, and the samples were centrifuged for 1 minute at 13,000 rpm to separate tissue from root-associated bacteria. Supernatants were split into two fractions, and one was used to characterize the microbiome through 16S rRNA amplicon sequencing and the remaining fraction was diluted and plated on Nitrogen-free Broth (NfB) media supplemented with 1.5% agar. Plates were incubated at 30° C. for 5-7 days. Colonies that emerged were tested for the presence of the nifH gene by colony PCR with primers Ueda19f and Ueda406r. Genomic DNA from strains with a positive nifH colony PCR was isolated (QIAamp DNA Mini Kit, Cat No. 51306, QIAGEN, Germany) and sequenced (Illumina MiSeq v3, SeqMatic, Fremont, CA). Following sequence assembly and annotation, the isolates containing nitrogen fixation gene clusters were utilized in downstream research.

Microbiome Profiling of Isolation Seedlings

Genomic DNA was isolated from root-associated bacteria using the ZR-96 Genomic DNA I Kit (Zymo Research P/N D3011), and 16S rRNA amplicons were generated using nextera-barcoded primers targeting 799f and 1114r. The amplicon libraries were purified and sequenced with the Illumina MiSeq v3 platform (SeqMatic, Fremont, CA). Reads were taxonomically classified using Kraken using the minikraken database (FIG. 2).

Acetylene Reduction Assay (ARA)

A modified version of the Acetylene Reduction Assay was used to measure nitrogenase activity in pure culture conditions. Strains were propagated from single colony in SOB (RPI, P/N S25040-1000) at 30° C. with shaking at 200 RPM for 24 hours and then subcultured 1:25 into growth medium and grown aerobically for 24 hours (30° C., 200 RPM). 1 ml of the minimal media culture was then added to 4 ml of minimal media supplemented with 0 to 10 mM glutamine in air-tight Hungate tubes and grown anaerobically for 4 hours (30° C., 200 RPM). 10% headspace was removed then replaced by an equal volume of acetylene by injection, and incubation continued for 1 hr. Subsequently, 2 ml of headspace was removed via gas tight syringe for quantification of ethylene production using an Agilent 6850 gas chromatograph equipped with a flame ionization detector (FID).

Ammonium Excretion Assay

Excretion of fixed nitrogen in the form of ammonia was measured using batch fermentation in anaerobic bioreactors. Strains were propagated from single colony in 1 ml/well of SOB in a 96 well DeepWell plate. The plate was incubated at 30° C. with shaking at 200 RPM for 24 hours and then diluted 1:25 into a fresh plate containing 1 ml/well of growth medium. Cells were incubated for 24 hours (30° C., 200 RPM) and then diluted 1:10 into a fresh plate containing minimal medium. The plate was transferred to an anaerobic chamber with a gas mixture of >98.5% nitrogen, 1.2-1.5% hydrogen and <30 ppM oxygen and incubated at 1350 RPM, room temperature for 66-70 hrs. Initial culture biomass was compared to ending biomass by measuring optical density at 590 nm. Cells were then separated by centrifugation, and supernatant from the reactor broth was assayed for free ammonia using the Megazyme Ammonia Assay kit (P/N K-AMIAR) normalized to biomass at each timepoint.

Extraction of Root-Associated Microbiome

Roots were shaken gently to remove loose particles, and root systems were separated and soaked in a RNA stabilization solution (Thermo Fisher P/N AM7021) for 30 minutes. The roots were then briefly rinsed with sterile deionized water. Samples were homogenized using bead beating with ½-inch stainless steel ball bearings in a tissue lyser (TissueLyser II, Qiagen P/N 85300) in 2 ml of lysis buffer (Qiagen P/N 79216). Genomic DNA extraction was performed with ZR-96 Quick-gDNA kit (Zymo Research P/N D3010), and RNA extraction using the RNeasy kit (Qiagen P/N 74104).

Root Colonization Assay

Four days after planting, 1 ml of a bacterial overnight culture (approximately $10^9$ cfu) was applied to the soil above the planted seed. Seedlings were fertilized three times weekly with 25 ml modified Hoagland's solution supplemented with 0.5 mM ammonium nitrate. Four weeks after planting, root samples were collected and the total genomic DNA (gDNA) was extracted. Root colonization was quantified using qPCR with primers designed to amplify unique regions of either the wild type or derivative strain genome. QPCR reaction efficiency was measured using a standard curve generated from a known quantity of gDNA from the target genome. Data was normalized to genome copies per g fresh weight using the tissue weight and extraction volume. For each experiment, the colonization numbers were compared to untreated control seedlings.

In Planta Transcriptomics

Transcriptional profiling of root-associated microbes was measured in seedlings grown and processed as described in the Root Colonization Assay. Purified RNA was sequenced using the Illumina NextSeq platform (SeqMatic, Fremont, CA). Reads were mapped to the genome of the inoculated strain using bowtie2 using '—very-sensitive-local' parameters and a minimum alignment score of 30. Coverage across the genome was calculated using samtools. Differential coverage was normalized to housekeeping gene expression and visualized across the genome using Circos and across the nif gene cluster using DNAplotlib. Additionally, the in planta transcriptional profile was quantified via targeted Nanostring analysis. Purified RNA was processed on an nCounter Sprint (Core Diagnostics, Hayward, CA).

15N Dilution Greenhouse Study

A 15N fertilizer dilution experiment was performed to assess optimized strain activity in planta. A planting medium containing minimal background N was prepared using a mixture of vermiculite and washed sand (5 rinses in DI $H_2O$). The sand mixture was autoclaved for 1 hour at 122° C. and approximately 600 g measured out into 40 cubic inch (656 mL) pots, which were saturated with sterile DI $H_2O$ and allowed to drain 24 hours before planting. Corn seeds (DKC 66-40) were surface sterilized in 0.625% sodium hypochlorite for 10 minutes, then rinsed five times in sterile distilled water and planted 1 cm deep. The plants were maintained under fluorescent lamps for four weeks with 16-hour day length at room temperatures averaging 22° C. (night) to 26° C. (day).

Five days after planting, seedlings were inoculated with a 1 ml suspension of cells drenched directly over the emerging coleoptile. Inoculum was prepared from 5 ml overnight cultures in SOB, which were spun down and resuspended twice in 5 ml PBS to remove residual SOB before final dilution to OD of 1.0 (approximately $10^9$ CFU/ml). Control plants were treated with sterile PBS, and each treatment was applied to ten replicate plants.

Plants were fertilized with 25 ml fertilizer solution containing 2% 15N-enriched 2 mM $KNO_3$ on 5, 9, 14, and 19 days after planting, and the same solution without $KNO_3$ on 7, 12, 16, and 18 days after planting. The fertilizer solution contained (per liter) 3 mmol $CaCl_2$), 0.5 mmol $KH_2PO_4$, 2 mmol $MgSO_4$, 17.9 µmol $FeSO_4$, 2.86 mg $H_3BO_3$, 1.81 mg $MnCl_2\cdot4H_2O$, 0.22 mg $ZnSO_4\cdot7H_2O$, 51 µg $CuSO_4\cdot5H_2O$, 0.12 mg $Na_2MoO_4\cdot2H_2O$, and 0.14 nmol $NiCl_2$. All pots were watered with sterile DI $H_2O$ as needed to maintain consistent soil moisture without runoff.

At four weeks, plants were harvested and separated at the lowest node into samples for root gDNA and RNA extraction and aerial tissue for IRMS. Aerial tissues were wiped as needed to remove sand, placed whole into paper bags and dried for at least 72 hours at 60° C. Once completely dry, total aerial tissue was homogenized by bead beating and 5-7 mg samples were analyzed by isotope ratio mass spectrometry (IRMS) for 815N by the MBL Stable Isotope Laboratory (The Ecosystems Center, Woods Hole, MA). Percent NDFA was calculated using the following formula: % NDFA=(815N of UTC average-815N of sample)/(815N of UTC average)×100.

Example 3: Field Trials with Remodeled Microbes of the Disclosure—Summer 2016

In order to evaluate the efficacy of remodeled strains of the present disclosure on corn growth and productivity under varying nitrogen regimes, field trials were conducted.

Trials were conducted with (1) seven subplot treatments of six strains plus the control—four main plots comprised 0, 15, 85, and 100% of maximum return to nitrogen (MRTN) with local verification. The control (UTC only) was conducted with 10 100% MRTN plus, 5, 10, or 15 pounds. Treatments had four replications.

Plots of corn (minimum) were 4 rows of 30 feet in length, with 124 plots per location. All observations were taken from the center two rows of the plots, and all destructive sampling was taken from the outside rows. Seed samples were refrigerated until 1.5 to 2 hours prior to use.

Local Agricultural Practice: The seed was a commercial corn without conventional fungicide and insecticide treatment. All seed treatments were applied by a single seed treatment specialist to assure uniformity. Planting date, seeding rate, weed/insect management, etc. were left to local agricultural practices. With the exception of fungicide applications, standard management practices were followed.

Soil Characterization: Soil texture and soil fertility were evaluated. Soil samples were pre-planted for each replicate to insure residual nitrate levels lower than 50 lbs/Ac. Soil cores were taken from 0 cm to 30 cm. The soil was further characterized for pH, CEC, total K and P.

Assessments: The initial plant population was assessed 14 days after planting (DAP)/acre, and were further assessed for: (1) vigor (1 to 10 scale, w/10=excellent) 14 DAP & V10; (2) recordation of disease ratings any time symptoms are evident in the plots; (3) record any differences in lodging if lodging occurs in the plots; (4) yield (Bu/acre), adjusted to standard moisture pct; (5) test weight; and (6) grain moisture percentage.

Sampling Requirements: The soil was sampled at three timepoints (prior to trial initiation, V10-VT, 1 week post-harvest). All six locations and all plots were sampled at 10 grams per sample (124 plots×3 timepoints×6 locations).

Colonization Sampling: Colonization samples were collected at two timepoints (V10 and VT) for five locations and six timepoints (V4, V8, V10, VT, R5, and Post-Harvest). Samples were collected as follows: (1) from 0% and 100% MRTN, 60 plots per location; (2) 4 plants per plot randomly selected from the outside rows; (3) 5 grams of root, 8 inches of stalk, and top three leaves—bagged and IDed each separately—12/bags per plot; (4) five locations (60 plots×2 timepoints×12 bags/plot); and one location (60 plots×6 timepoints×12 bags/plot).

Normalized difference vegetation index (NDVI) determination was made using a Greenseeker instrument at two timepoints (V4-V6 and VT). Assessed each plot at all six locations (124 plots×2 timepoints×6 locations).

Root analysis was performed with Win Rhizo from one location that best illustrated treatment differentiation. Ten plants per plot were randomly sampled (5 adjacent from each outside row; V3-V4 stage plants were preferred) and gently washed to remove as much dirt as reasonable. Ten roots were placed in a plastic bag and labelled. Analyzed with WinRhizo Root Analysis.

Stalk Characteristics were measured at all six locations between R2 and R5. The stalk diameter of ten plants per plot at the 6" height were recorded, as was the length of the first internode above the 6" mark. Ten plants were monitored; five consecutive plants from the center of the two inside rows. Six locations were evaluated (124 plots×2 measures×6 locations).

The tissue nitrates were analyzed from all plots and all locations. An 8" segment of stalk beginning 6" above the soil when the corn is between one and three weeks after black layer formation; leaf sheaths were removed. All locations and plots were evaluated (6 locations×124 plots).

The following weather data was recorded for all locations from planting to harvest: daily maximum and minimum temperatures, soil temperature at seeding, daily rainfall plus irrigation (if applied), and any unusual weather events such as excessive rain, wind, cold, or heat.

Yield data across all six locations is presented in Table 26. Nitrogen rate had a significant impact on yield, but strains across nitrogen rates did not. However, at the lowest nitrogen rate, strains CI006, CM029, and CI019 numerically out-yielded the UTC by 4 to 6 bu/acre. Yield was also numerically increased 2 to 4 bu/acre by strains CM029, CI019, and CM081 at 15% MRTN.

TABLE 26

| | YLD (bu) | Vigor_E | Vigor_L | Stalk Diameter (mm) | Internode Length (in) | NDVI_Veg | NDVI_Rep |
|---|---|---|---|---|---|---|---|
| Yield data across all six locations | | | | | | | |
| MRTN % | | | | | | | |
| 0 | 143.9 | 7.0 | 5.7 | 18.87 | 7.18 | 64.0 | 70.6 |
| 15 | 165.9 | 7.2 | 6.3 | 19.27 | 7.28 | 65.8 | 72.5 |
| 85 | 196.6 | 7.1 | 7.1 | 20.00 | 7.31 | 67.1 | 74.3 |
| 100 | 197.3 | 7.2 | 7.2 | 20.23 | 7.37 | 66.3 | 72.4 |
| Strain | | | | | | | |
| CI006 (1) | 176.6 | 7.2 | 6.6 | 19.56 | 18.78 | 66.1 | 72.3 |
| CM029 (2) | 176.5 | 7.1 | 6.5 | 19.54 | 18.61 | 65.4 | 71.9 |
| CM038 (3) | 175.5 | 7.2 | 6.5 | 19.58 | 18.69 | 65.7 | 72.8 |
| CI019 (4) | 176.0 | 7.1 | 6.6 | 19.51 | 18.69 | 65.5 | 72.9 |
| CM081 (5) | 176.2 | 7.1 | 6.6 | 19.57 | 18.69 | 65.8 | 73.1 |
| CM029/CM081 (6) | 174.3 | 7.1 | 6.6 | 19.83 | 18.79 | 66.2 | 72.5 |
| UTC (7) | 176.4 | 7.1 | 6.6 | 19.54 | 18.71 | 65.9 | 71.7 |

TABLE 26-continued

| | | Yield data across all six locations | | | | | | |
|---|---|---|---|---|---|---|---|---|
| | | YLD (bu) | Vigor_E | Vigor_L | Stalk Diameter (mm) | Internode Length (in) | NDVI_Veg | NDVI_Rep |
| MRTN/Strain | | | | | | | | |
| 0 | 1 | 145.6 | 7.0 | 5.6 | 19.07 | 7.12 | 63.5 | 70.3 |
| 0 | 2 | 147.0 | 7.0 | 5.5 | 18.74 | 7.16 | 64.4 | 70.4 |
| 0 | 3 | 143.9 | 7.0 | 5.5 | 18.83 | 7.37 | 64.6 | 70.5 |
| 0 | 4 | 146.0 | 6.9 | 5.7 | 18.86 | 7.15 | 63.4 | 70.7 |
| 0 | 5 | 141.7 | 7.0 | 5.8 | 18.82 | 7.05 | 63.6 | 70.9 |
| 0 | 6 | 142.2 | 7.2 | 5.8 | 19.12 | 7.09 | 64.7 | 69.9 |
| 0 | 7 | 141.2 | 7.0 | 5.8 | 18.64 | 7.32 | 64.0 | 71.4 |
| 15 | 1 | 164.2 | 7.3 | 6.1 | 19.09 | 7.21 | 66.1 | 71.5 |
| 15 | 2 | 167.3 | 7.2 | 6.3 | 19.32 | 7.29 | 65.5 | 72.7 |
| 15 | 3 | 165.6 | 7.3 | 6.3 | 19.36 | 7.23 | 64.8 | 72.5 |
| 15 | 4 | 167.9 | 7.3 | 6.4 | 19.31 | 7.51 | 66.1 | 72.3 |
| 15 | 5 | 169.3 | 7.2 | 6.2 | 19.05 | 7.32 | 66.0 | 72.8 |
| 15 | 6 | 161.9 | 7.1 | 6.3 | 19.45 | 7.20 | 66.2 | 72.2 |
| 15 | 7 | 165.1 | 7.3 | 6.4 | 19.30 | 7.18 | 66.0 | 73.3 |
| 85 | 1 | 199.4 | 7.3 | 7.2 | 19.70 | 7.32 | 67.2 | 74.0 |
| 85 | 2 | 195.1 | 7.1 | 7.2 | 19.99 | 7.09 | 66.5 | 74.4 |
| 85 | 3 | 195.0 | 7.0 | 7.0 | 20.05 | 7.26 | 67.3 | 74.6 |
| 85 | 4 | 195.6 | 7.2 | 7.1 | 20.04 | 7.29 | 66.4 | 74.4 |
| 85 | 5 | 196.4 | 7.2 | 7.0 | 19.87 | 7.39 | 67.3 | 74.5 |
| 85 | 6 | 195.1 | 7.0 | 6.9 | 20.35 | 7.34 | 67.4 | 74.4 |
| 85 | 7 | 199.5 | 6.9 | 7.2 | 19.97 | 7.48 | 67.4 | 74.1 |
| 100 | 1 | 197.1 | 7.2 | 7.3 | 20.38 | 7.68 | 67.5 | 73.4 |
| 100 | 2 | 196.5 | 7.0 | 7.1 | 20.11 | 7.21 | 65.3 | 70.2 |
| 100 | 3 | 197.6 | 7.5 | 7.3 | 20.08 | 7.42 | 66.3 | 73.4 |
| 100 | 4 | 194.6 | 7.1 | 7.1 | 19.83 | 7.40 | 66.1 | 74.1 |
| 100 | 5 | 197.4 | 7.2 | 7.3 | 20.53 | 7.36 | 66.2 | 74.3 |
| 100 | 6 | 198.1 | 7.2 | 7.4 | 20.40 | 7.16 | 66.6 | 73.6 |
| 100 | 7 | 199.9 | 7.2 | 7.2 | 20.26 | 7.32 | 66.2 | 68.1 |

Another analysis approach is presented in Table 27. The table comprises the four locations where the response to nitrogen was the greatest which suggests that available residual nitrogen was lowest. This approach does not alter the assessment that the nitrogen rate significantly impacted yield, which strains did not when averaged across all nitrogen rates. However, the numerical yield advantage at the lowest N rate is more pronounced for all strains, particularly CI006, CM029, and CM029/CM081 where yields were increased from 8 to 10 bu/acre. At 15% MRTN, strain CM081 outyielded UTC by 5 bu.

TABLE 27

| | | Yield data across four locations 4 Location Average-SGS, AgIdea, Bennett, RFR | | | | |
|---|---|---|---|---|---|---|
| | | YLD (bu) | Vigor_E | Vigor_L | Stalk Diameter (mm) | Internode Length (in) |
| MRTN % | | | | | | |
| 0 | | 137.8 | 7.3 | 5.84 | 18.10 | 5.36 |
| 15 | | 162.1 | 7.5 | 6.63 | 18.75 | 5.40 |
| 85 | | 199.2 | 7.4 | 7.93 | 19.58 | 5.62 |
| 100 | | 203.5 | 7.5 | 8.14 | 19.83 | 5.65 |
| Strain | | | | | | |
| CI006 (1) | | 175.4 | 7.5 | 7.08 | 19.03 | 5.59 |
| CM029 (2) | | 176.1 | 7.4 | 7.08 | 19.09 | 5.39 |
| CM038 (3) | | 175.3 | 7.5 | 7.05 | 19.01 | 5.59 |
| CI019 (4) | | 174.8 | 7.5 | 7.16 | 19.02 | 5.45 |
| CM081 (5) | | 176.7 | 7.4 | 7.16 | 19.00 | 5.53 |
| CM029/CM081 (6) | | 175.1 | 7.4 | 7.17 | 19.33 | 5.46 |
| UTC (7) | | 176.0 | 7.3 | 7.27 | 18.98 | 5.55 |
| MRTN/Strain | | | | | | |
| 0 | 1 | 140.0 | 7.3 | 5.69 | 18.32 | 5.28 |
| 0 | 2 | 140.7 | 7.4 | 5.69 | 18.19 | 5.23 |
| 0 | 3 | 135.5 | 7.3 | 5.63 | 17.95 | 5.50 |
| 0 | 4 | 138.8 | 7.3 | 5.81 | 17.99 | 5.36 |
| 0 | 5 | 136.3 | 7.3 | 6.06 | 18.05 | 5.34 |
| 0 | 6 | 141.4 | 7.5 | 6.00 | 18.43 | 5.30 |
| 0 | 7 | 131.9 | 7.3 | 6.00 | 17.75 | 5.48 |
| 15 | 1 | 158.0 | 7.6 | 6.44 | 18.53 | 5.34 |

TABLE 27-continued

Yield data across four locations
4 Location Average-SGS, Agldea, Bennett, RFR

| | | YLD (bu) | Vigor_E | Vigor_L | Stalk Diameter (mm) | Internode Length (in) |
|---|---|---|---|---|---|---|
| 15 | 2 | 164.1 | 7.5 | 6.56 | 19.13 | 5.42 |
| 15 | 3 | 164.3 | 7.6 | 6.63 | 18.68 | 5.51 |
| 15 | 4 | 163.5 | 7.6 | 6.81 | 18.84 | 5.34 |
| 15 | 5 | 166.8 | 7.5 | 6.63 | 18.60 | 5.39 |
| 15 | 6 | 156.6 | 7.4 | 6.56 | 18.86 | 5.41 |
| 15 | 7 | 161.3 | 7.5 | 6.81 | 18.62 | 5.42 |
| 85 | 1 | 199.4 | 7.6 | 8.00 | 19.15 | 5.63 |
| 85 | 2 | 199.0 | 7.4 | 8.09 | 19.49 | 5.46 |
| 85 | 3 | 198.2 | 7.4 | 7.75 | 19.88 | 5.69 |
| 85 | 4 | 196.8 | 7.4 | 8.00 | 19.65 | 5.60 |
| 85 | 5 | 199.5 | 7.4 | 7.75 | 19.26 | 5.70 |
| 85 | 6 | 198.7 | 7.3 | 7.81 | 19.99 | 5.61 |
| 85 | 7 | 202.8 | 7.2 | 8.13 | 19.66 | 5.65 |
| 100 | 1 | 204.3 | 7.4 | 8.19 | 20.11 | 6.10 |
| 100 | 2 | 200.6 | 7.3 | 8.00 | 19.53 | 5.46 |
| 100 | 3 | 203.3 | 7.7 | 8.19 | 19.55 | 5.67 |
| 100 | 4 | 200.2 | 7.6 | 8.00 | 19.59 | 5.49 |
| 100 | 5 | 203.9 | 7.4 | 8.19 | 20.08 | 5.68 |
| 100 | 6 | 203.8 | 7.5 | 8.31 | 20.05 | 5.52 |
| 100 | 7 | 208.1 | 7.4 | 8.13 | 19.90 | 5.63 |

The results from the field trial are also illustrated in FIGS. 9-15. The results indicate that the microbes of the disclosure are able to increase plant yield, which points to the ability of the taught microbes to increase nitrogen fixation in an important agricultural crop, i.e. corn.

The field based results further validate the disclosed methods of non-intergenerically modifying the genome of selected microbial strains, in order to bring about agriculturally relevant results in a field setting when applying said engineered strains to a crop.

FIG. 6 depicts the lineage of modified remodeled strains that were derived from strain CI006 (WT *Kosakonia sacchari*). The field data demonstrates that an engineered derivative of the CI006 WT strain, i.e. CM029, is able to bring about numerically relevant results in a field setting. For example, Table 26 illustrates that at 0% MRTN CM029 yielded 147.0 bu/acre compared to untreated control at 141.2 bu/acre (an increase of 5.8 bu/acre). Table 26 also illustrates that at 15% MRTN CM029 yielded 167.3 bu/acre compared to untreated control at 165.1 bu/acre (an increase of 2.2 bu/acre). Table 27 is supportive of these conclusions and illustrates that at 0% MRTN CM029 yielded 140.7 bu/acre compared to untreated control at 131.9 bu/acre (an increase of 8.8 bu/acre). Table 27 also illustrates that at 15% MRTN CM029 yielded 164.1 bu/acre compared to untreated control at 161.3 bu/acre (an increase of 2.8 bu/acre).

FIG. 7 depicts the lineage of modified remodeled strains that were derived from strain CI019 (WT *Rahnella aquatilis*). The field data demonstrates that an engineered derivative of the CI019 WT strain, i.e. CM081, is able to bring about numerically relevant results in a field setting. For example, Table 26 illustrates that at 15% MRTN CM081 yielded 169.3 bu/acre compared to untreated control at 165.1 bu/acre (an increase of 4.2 bu/acre). Table 27 is supportive of these conclusions and illustrates that at 0% MRTN CM081 yielded 136.3 bu/acre compared to untreated control at 131.9 bu/acre (an increase of 4.4 bu/acre). Table 27 also illustrates that at 15% MRTN CM081 yielded 166.8 bu/acre compared to untreated control at 161.3 bu/acre (an increase of 5.5 bu/acre).

Further, one can see in Table 27 that the combination of CM029/CM081 at 0% MRTN yielded 141.4 bu/acre compared to untreated control at 131.9 bu/acre (an increase of 9.5 bu/acre).

Example 4: Field Trials with Remodeled Microbes of the Disclosure-Summer 2017

In order to evaluate the efficacy of remodeled strains of the present disclosure on corn growth and productivity under varying nitrogen regimes, field trials were conducted. The below field data demonstrates that the non-intergeneric microbes of the disclosure are able to fix atmospheric nitrogen and deliver said nitrogen to a plant-resulting in increased yields—in both a nitrogen limiting environment, as well as a non-nitrogen limiting environment.

Trials were conducted at seven locations across the United States with six geographically diverse Midwestern locations. Five nitrogen regimes were used for fertilizer treatments: 100% of standard agricultural practice of the site/region, 100% minus 25 pounds, 100% minus 50 pounds, 100% minus 75 pounds, and 0%; all per acre. The pounds of nitrogen per acre for the 100% regime depended upon the standard agricultural practices of the site/region. The aforementioned nitrogen regimes ranged from about 153 pounds per acre to about 180 pounds per acre, with an average of about 164 pounds of nitrogen per acre.

Within each fertilizer regime, there were 14 treatments. Each regime had six replications, and a split plot design was utilized. The 14 treatments included: 12 different microbes, 1 UTC with the same fertilizer rate as the main plot, and 1 UTC with 100% nitrogen. In the 100% nitrogen regime the 2nd UTC is 100 plus 25 pounds.

Plots of corn, at a minimum, were 4 rows of 30 feet in length (30 inches between rows) with 420 plots per location. All observations, unless otherwise noted, were taken from the center two rows of the plants, and all destructive sampling was taken from the outside rows. Seed samples were refrigerated until 1.5 to 2 hours prior to use.

Local Agricultural Practice: The seed was a commercial corn applied with a commercial seed treatment with no biological co-application. The seeding rate, planting date, weed/insect management, harvest times, and other standard management practices were left to the norms of local agricultural practices for the regions, with the exception of fungicide application (if required).

Microbe Application: The microbes were applied to the seed in a seed treatment over seeds that had already received a normal chemical treatment. The seed were coated with fermentation broth comprising the microbes.

Soil Characterization: Soil texture and soil fertility were evaluated. Standard soil sampling procedures were utilized, which included soil cores of depths from 0-30 cm and 30-60 cm. The standard soil sampling included a determination of nitrate nitrogen, ammonium nitrogen, total nitrogen, organic matter, and CEC. Standard soil sampling further included a determination of pH, total potassium, and total phosphorous. To determine the nitrogen fertilizer levels, preplant soil samples from each location were taken to ensure that the 0-12" and potentially the 12" to 24" soil regions for nitrate nitrogen.

Prior to planting and fertilization, 2 ml soil samples were collected from 0 to 6-12" from the UTC. One sample per replicate per nitrogen region was collected using the middle of the row. (5 fertilizer regimes×6 replicates=thirty soil samples).

Post-planting (V4-V6), 2 ml soil samples were collected from 0 to 6-12" from the UTC. One sample per replicate per nitrogen region was collected using the middle of the row. (5 fertilizer regimes×6 replicates=thirty soil samples).

Post-harvest (V4-V6), 2 ml soil samples were collected from 0 to 6-12" from the UTC. One sample per replicate per nitrogen region was collected using the middle of the row. Additional post-harvest soil sample collected at 0-12" from the UTC and potentially 12-24" from the UTC (5 fertilizer regimes×6 replicates=thirty soil samples).

A V6-V10 soil sample from each fertilizer regime (excluding the treatment of 100% and 100%+25 lbs [in the 100% block] for all fertilizer regimes at 0-12" and 12-24". (5 fertilizer regimes×2 depths=10 samples per location).

Post-harvest soil sample from each fertilizer regime (excluding the treatment of 100% and 100%+25 lbs [in the 100% block] for all fertilizer regimes at 0-12" and 12-24". (5 fertilizer regimes×2 depths=10 samples per location).

Assessments: The initial plant population was assessed at ~50% UTC and the final plant population was assessed prior to harvest. Assessment included (1) potentially temperature (temperature probe); (2) vigor (1-10 scale with 10=excellent) at V4 and V8-V10; (3) plant height at V8-V10 and V14; (4) yield (bushels/acre) adjusted to standard moisture percentage; (5) test weight; (6) grain moisture percentage; (7) stalk nitrate tests at black layer (420 plots×7 locations); (8) colonization with 1 plant per plot in zip lock bag at 0% and 100% fertilizer at V4-V6 (1 plant×14 treatments×6 replicates×2 fertilizer regimes=168 plants); (9) transcriptomics with 1 plant per plot in zip lock bag at 0% and 100% fertilizer at V4-V6 (1 plant×14 treatments×6 replicates×2 fertilizer regimes=168 plants); (10) Normalized difference vegetative index (NDVI) or normalized difference red edge (NDRE) determination using a Greenseeker instrument at two time points (V4-V6 and VT) to assess each plot at all 7 locations (420 plots×2 time points×7 locations=5,880 data points); (11) stalk characteristics measured at all 7 locations between R2 and R5 by recording the stalk diameter of 10 plants/plot at 6" height, record length of first internode above the 6" mark, 10 plants monitored (5 consecutive plants from center of two inside rows) (420 plots×10 plants×7 locations=29,400 data points).

Monitoring Schedule: Practitioners visited all trials at V3-V4 stage to assess early-season response to treatments and during reproductive growth stage to monitor maturity. Local cooperator visited research trial on an on-going basis.

Weather Information: Weather data spanning from planting to harvest was collected and consisted of daily minimum and maximum temperatures, soil temperature at seeding, daily rainfall plus irrigation (if applied), and unusual weather events such as excessive wind, rain, cold, heat.

Data Reporting: Including the data indicated above, the field trials generated data points including soil textures; row spacing; plot sizes; irrigation; tillage; previous crop; seeding rate; plant population; seasonal fertilizer inputs including source, rate, timing, and placement; harvest area dimensions, method of harvest, such as by hand or machine and measurement tools used (scales, yield monitor, etc.)

Results: Select results from the aforementioned field trial are reported in FIG. 16 and FIG. 17.

Figure 16:
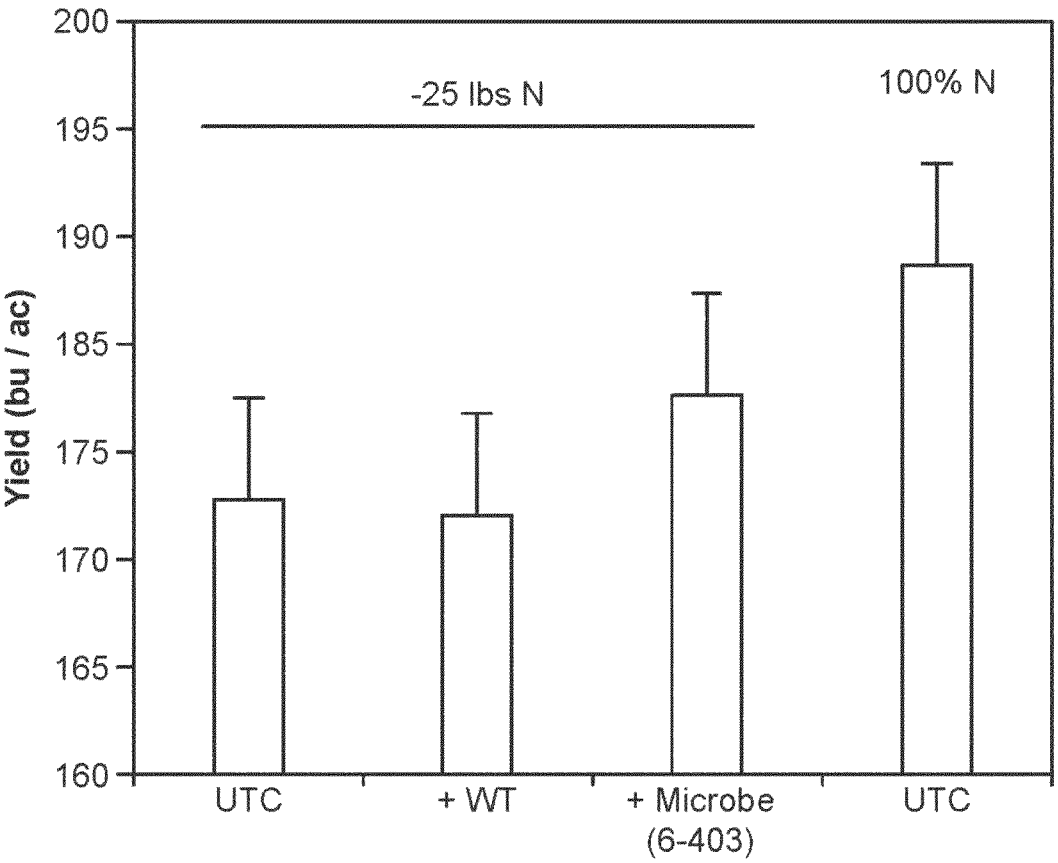
FIG. 16 illustrates results from a summer 2017 field testing experiment. The yield results obtained demonstrate that the microbes of the disclosure can serve as a potential fertilizer replacement. For instance, the utilization of a microbe of the disclosure (i.e. 6-403) resulted in a higher yield than the wild type strain (WT) and a higher yield than the untreated control (UTC). The "−25 lbs N" treatment utilizes 25 lbs less N per acre than standard agricultural practices of the region. The "100% N" UTC treatment is meant to depict standard agricultural practices of the region, in which 100% of the standard utilization of N is deployed by the farmer. The microbe "6-403" was deposited as NCMA 201708004 and can be found in Table 1. This is a mutant *Kosakonia sacchari* (also called CM037) and is a progeny mutant strain from CI006 WT.

In FIG. 16, it can be seen that a remodeled microbe of the disclosure (i.e. 6-403) resulted in a higher yield than the wild type strain (WT) and a higher yield than the untreated control (UTC). The "−25 lbs N" treatment utilizes 25 lbs less N per acre than standard agricultural practices of the region. The "100% N" UTC treatment is meant to depict standard agricultural practices of the region, in which 100% of the standard utilization of N is deployed by the farmer. The microbe "6-403" was deposited as NCMA 201708004 and can be found in Table 1. This is a mutant *Kosakonia sacchari* (also called CM037) and is a progeny mutant strain from CI006 WT.

Figure 17:
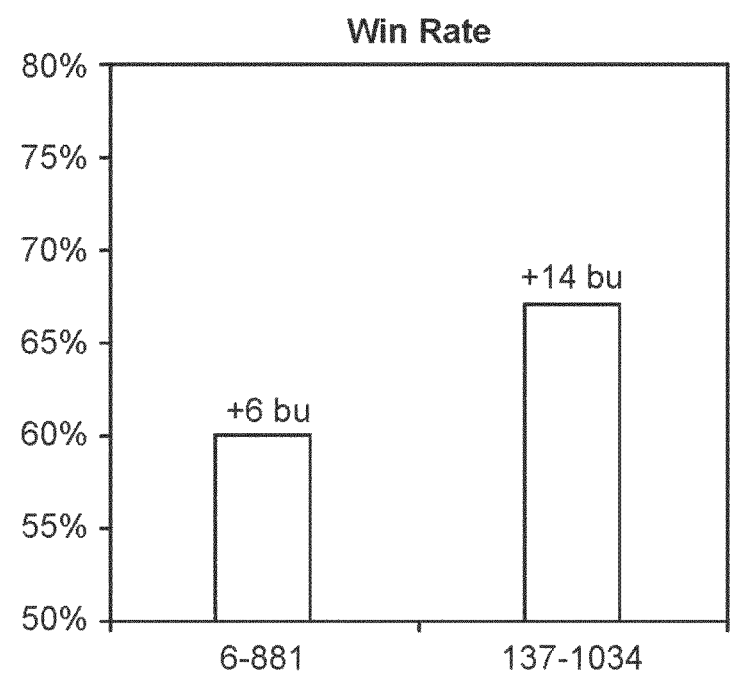
FIG. 17 illustrates results from a summer 2017 field testing experiment. The yield results obtained demonstrate that the microbes of the disclosure perform consistently across locations. Furthermore, the yield results demonstrate that the microbes of the disclosure perform well in both a nitrogen stressed environment, as well as an environment that has sufficient supplies of nitrogen. The microbe "6-881" (also known as CM094, PBC6.94), and which is a progeny mutant *Kosakonia sacchari* strain from CI006 WT, was deposited as NCMA 201708002 and can be found in Table 1. The microbe "137-1034," which is a progeny mutant *Klebsiella variicola* strain from CI137 WT, was deposited as NCMA 201712001 and can be found in Table 1. The microbe "137-1036," which is a progeny mutant *Klebsiella variicola* strain from CI137 WT, was deposited as NCMA 201712002 and can be found in Table 1. The microbe "6-404" (also known as CM38, PBC6.38), and which is a progeny mutant *Kosakonia sacchari* strain from CI006 WT, was deposited as NCMA 201708003 and can be found in Table 1. The "Nutrient Stress" condition corresponds to the 0% nitrogen regime. The "Sufficient Fertilizer" condition corresponds to the 100% nitrogen regime.
Figure 17:
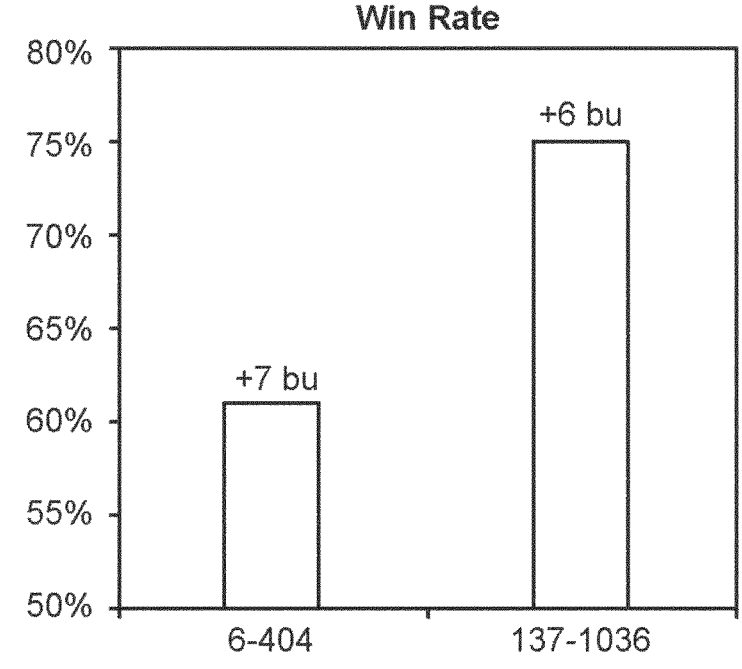
Figure 18:
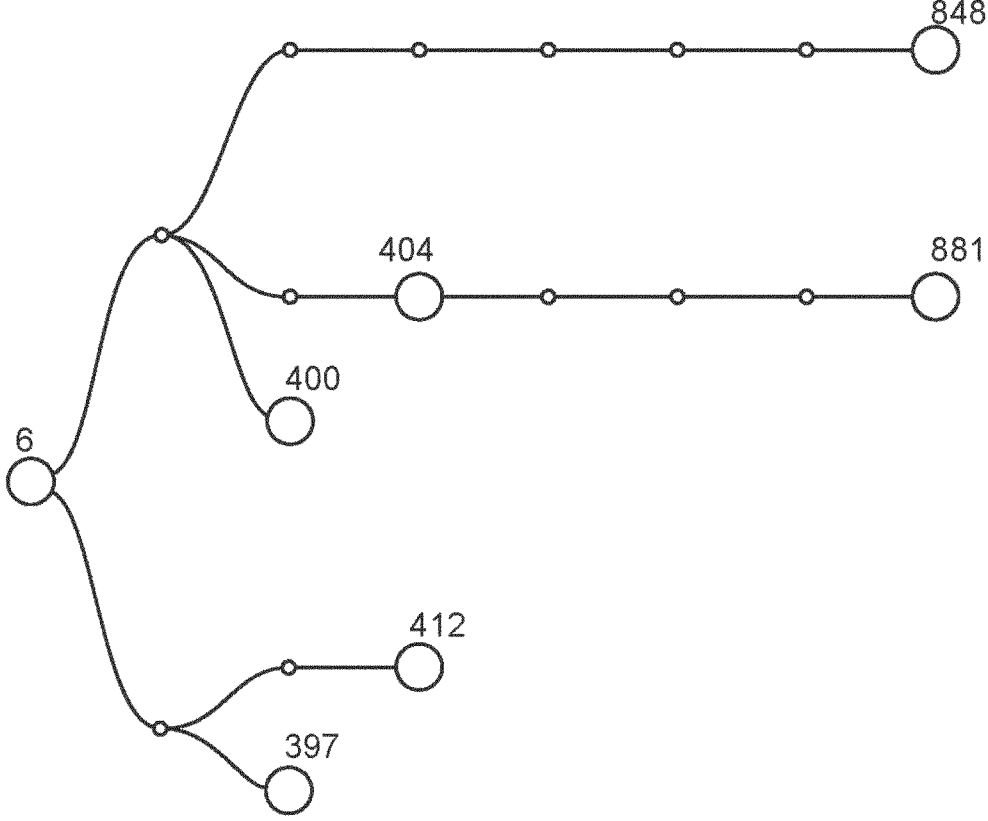
FIG. 18 depicts the lineage of modified strains that were derived from strain CI006 (also termed "6", *Kosakonia sacchari* WT).
Figure 19:
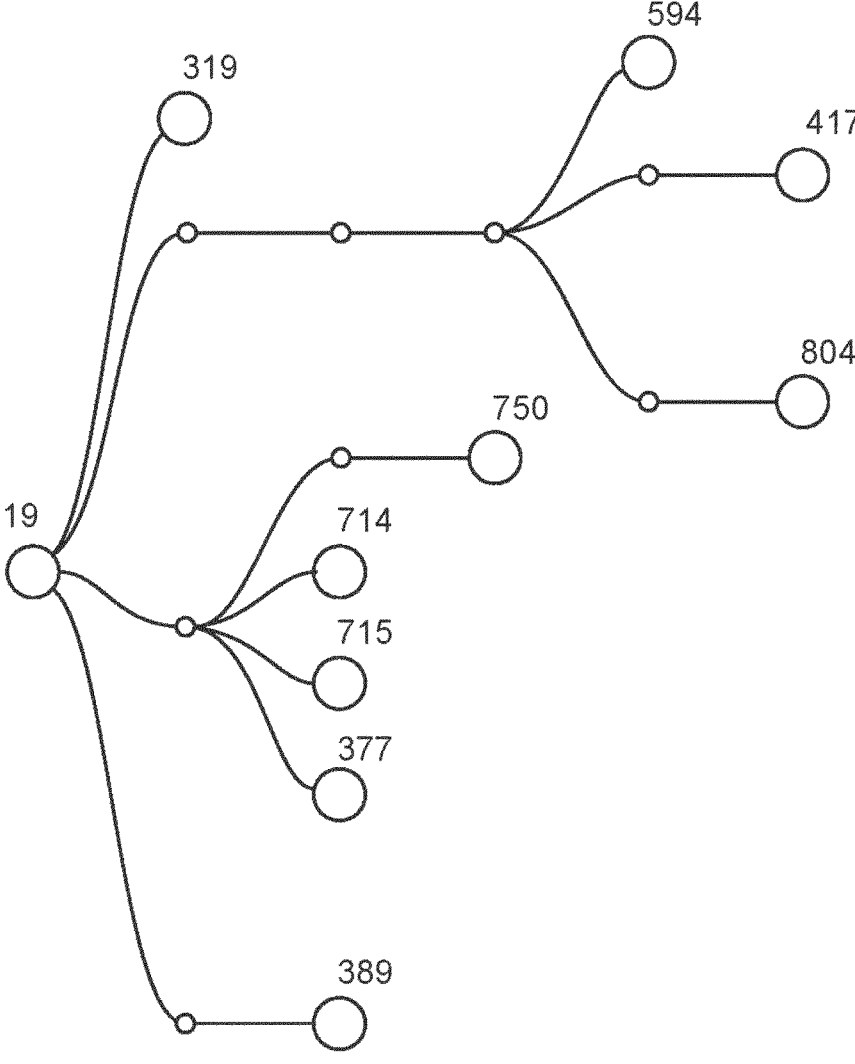
FIG. 19 depicts the lineage of modified strains that were derived from strain CI019 (also termed "19", *Rahnella aquatilis* WT).
Figure 20:
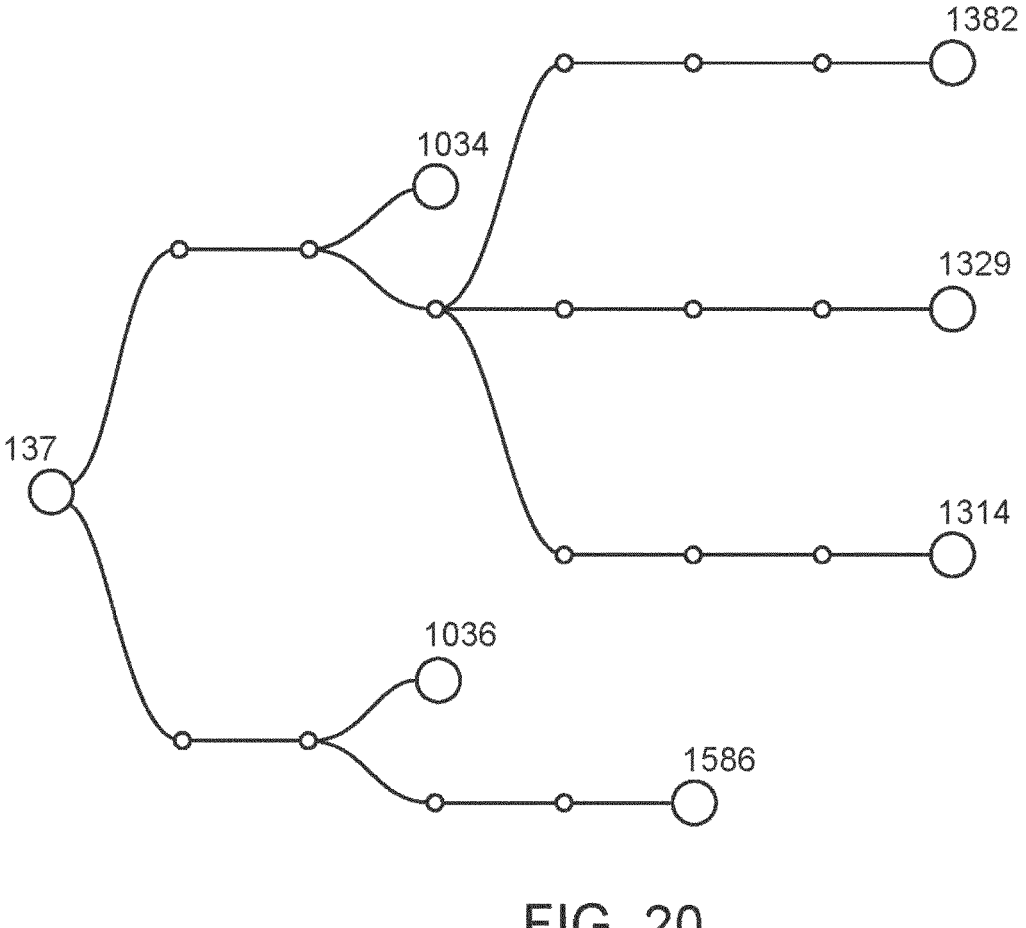
FIG. 20 depicts the lineage of modified strains that were derived from strain CI137 (also termed ("137", *Klebsiella variicola* WT).
Figure 21:
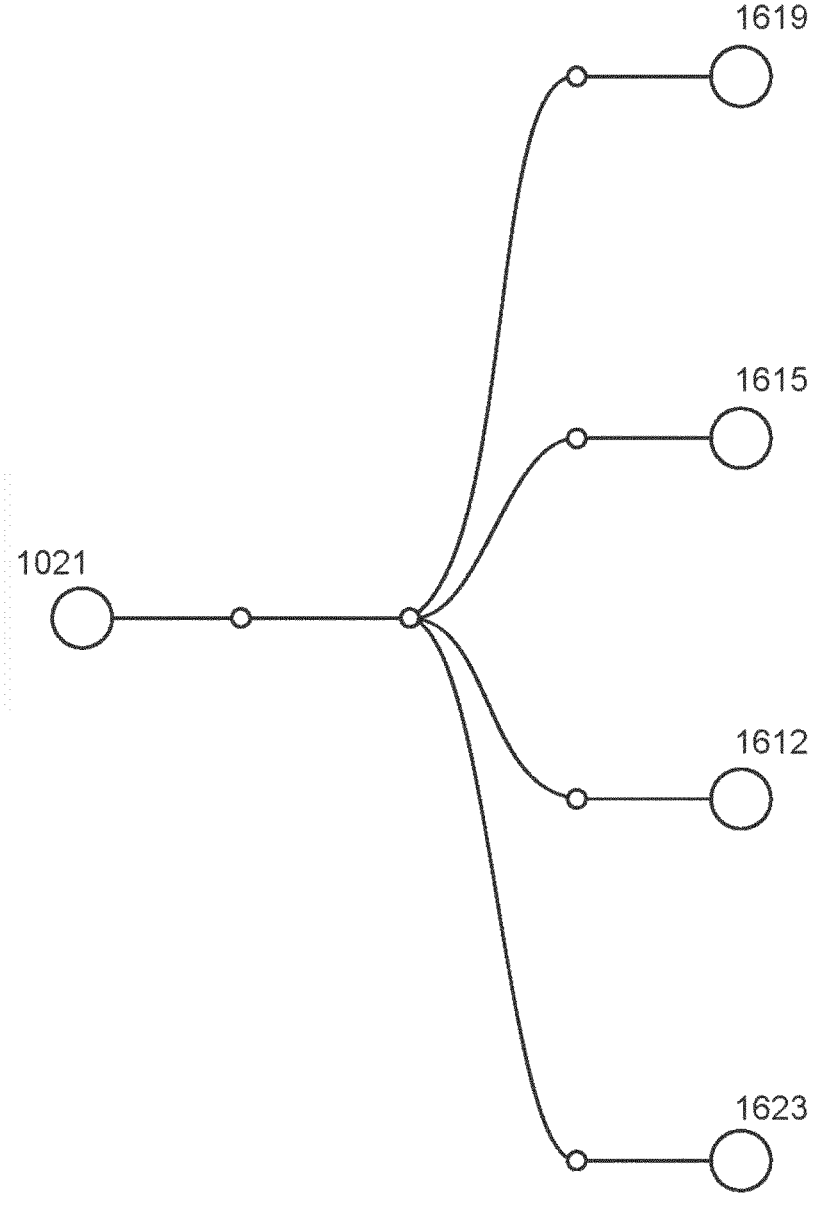
FIG. 21 depicts the lineage of modified strains that were derived from strain 1021 (*Kosakonia pseudosacchari* WT).
Figure 22:
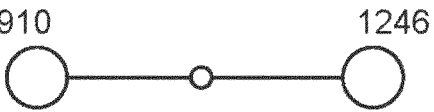
FIG. 22 depicts the lineage of modified strains that were derived from strain 910 (*Kluyvera intermedia* WT).
Figure 23:
FIG. 23 depicts the lineage of modified strains that were derived from strain 63 (*Rahnella aquatilis* WT).

In FIG. 17, the yield results obtained demonstrate that the remodeled microbes of the disclosure perform consistently across locations. Furthermore, the yield results demonstrate that the microbes of the disclosure perform well in both a nitrogen stressed environment (i.e. a nitrogen limiting environment), as well as an environment that has sufficient supplies of nitrogen (i.e. a non-nitrogen-limiting condition). The microbe "6-881" (also known as CM094, PBC6.94), and which is a progeny mutant *Kosakonia sacchari* strain from CI006 WT, was deposited as NCMA 201708002 and can be found in Table 1. The microbe "137-1034," which is a progeny mutant *Klebsiella variicola* strain from CI137 WT, was deposited as NCMA 201712001 and can be found in Table 1. The microbe "137-1036," which is a progeny mutant *Klebsiella variicola* strain from CI137 WT, was deposited as NCMA 201712002 and can be found in Table 1. The microbe "6-404" (also known as CM38, PBC6.38), and which is a progeny mutant *Kosakonia sacchari* strain from CI006 WT, was deposited as NCMA 201708003 and can be found in Table 1.

Example 5: Genus of Non-Intergeneric Remodeled Microbes Beneficial for Agricultural Systems The remodeled microbes of the present disclosure were evaluated and compared against one another for the production of nitrogen produced in an acre across a season. See FIG. 8, FIG. 24, and FIG. 25.

It is hypothesized by the inventors that in order for a population of engineered non-intergeneric microbes to be beneficial in a modern row crop agricultural system, then the population of microbes needs to produce at least one pound or more of nitrogen per acre per season.

Figure 8:
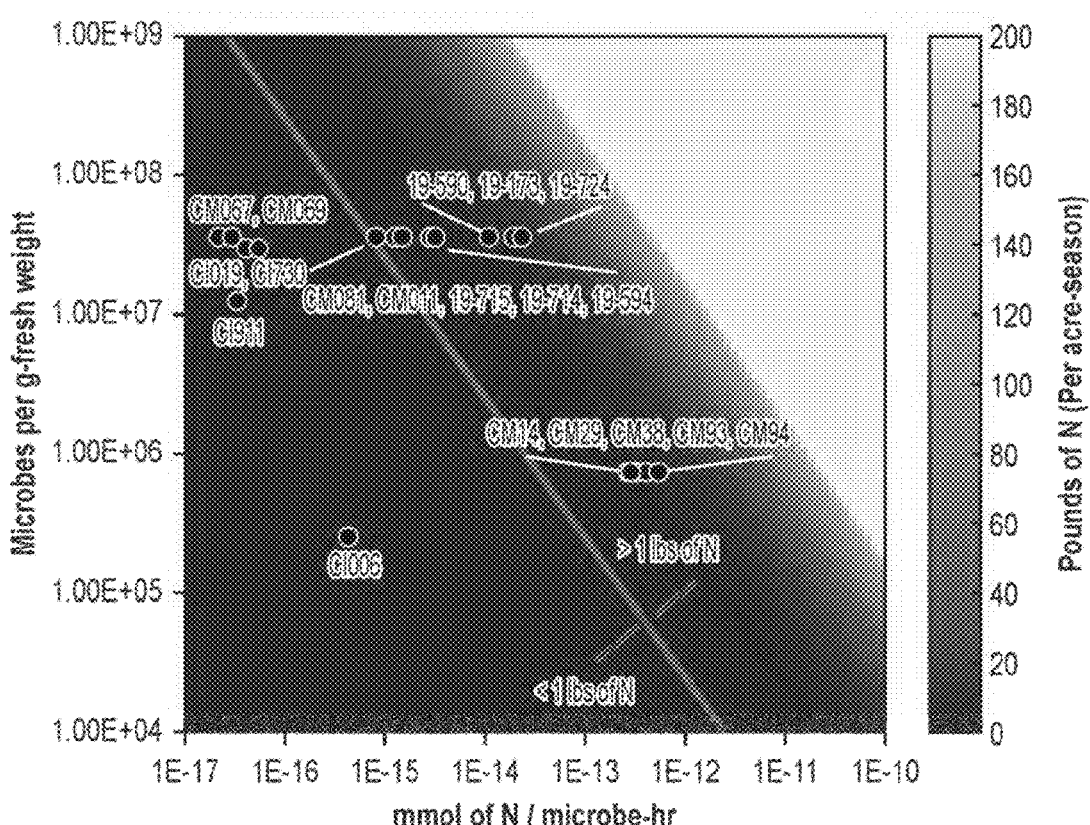
FIG. 8 depicts a heatmap of the pounds of nitrogen delivered per acre-season by microbes of the present disclosure recorded as a function of microbes per g-fresh weight by mmol of nitrogen/microbe-hr. Below the thin line that transects the larger image are the microbes that deliver less than one pound of nitrogen per acre-season, and above the line are the microbes that deliver greater than one pound of nitrogen per acre-season. The table below the heatmap gives the precise value of mmol N produced per microbe per hour (mmol N/Microbe hr) along with the precise CFU per gram of fresh weight (CFU/g fw) for each microbe shown in the heatmap. The microbes utilized in the heatmap were assayed for N production in corn. For the WT strains CI006 and CI019, corn root colonization data was taken from a single field site. For the remaining strains, colonization was assumed to be the same as the WT field level. N-fixation activity was determined using an in vitro ARA assay at 5 mM glutamine.
Figure 9:
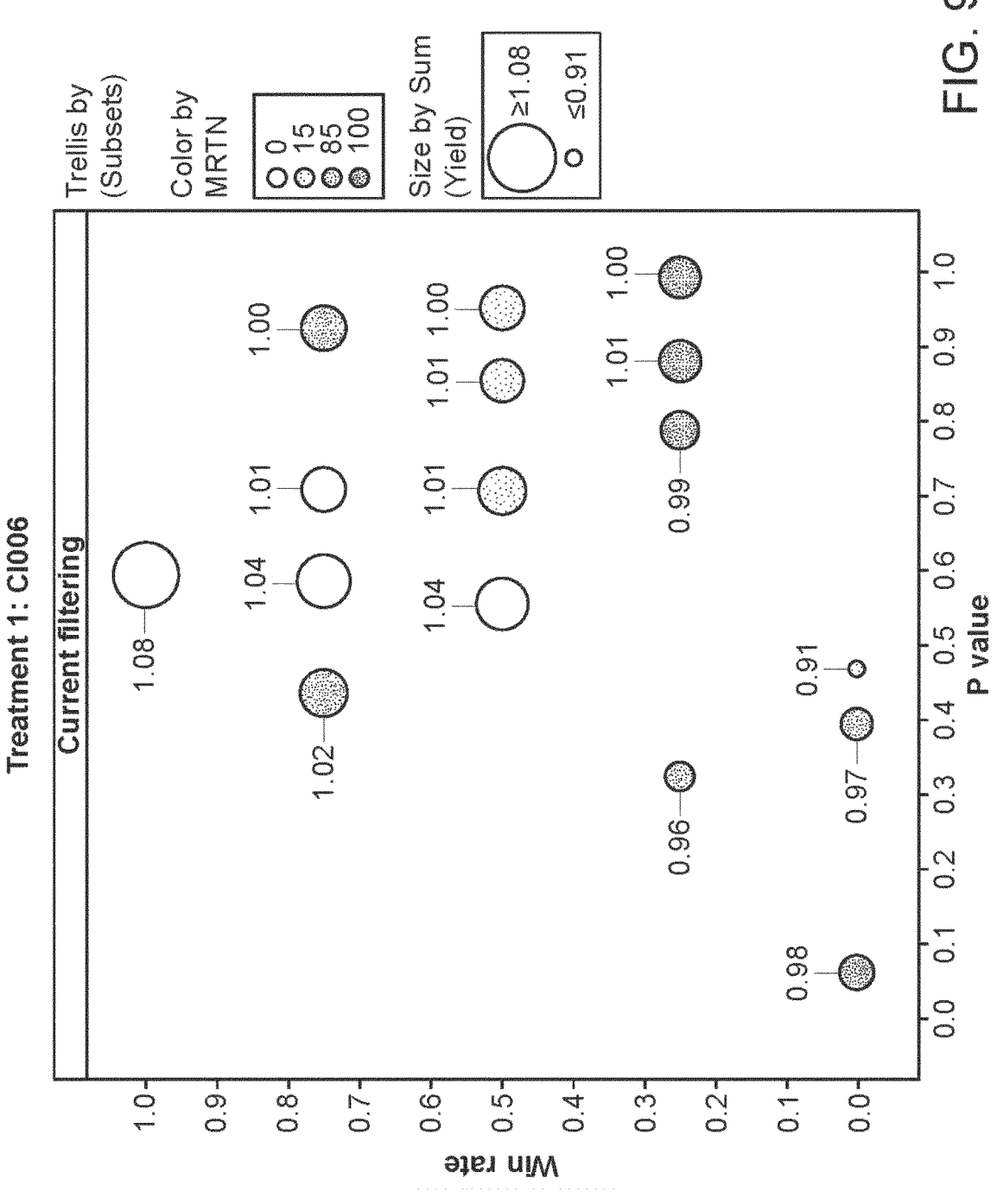
FIG. 9 depicts the plant yield of plants having been exposed to strain CI006. The area of the circles corresponds to the relative yield, while the shading corresponds to the particular MRTN treatment. The x-axis is the p value and the y-axis is the win rate.
Figure 10:
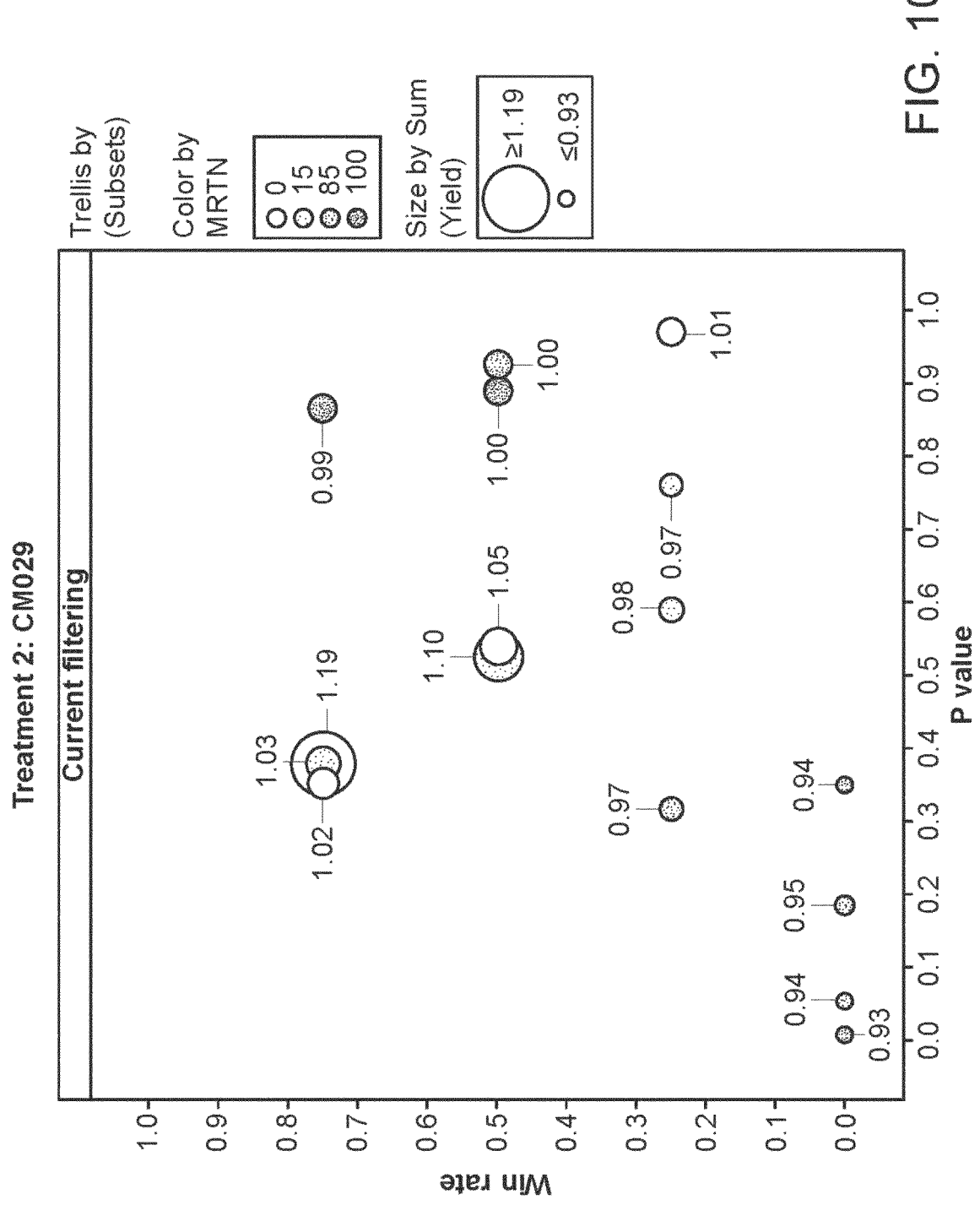
Figure 11:
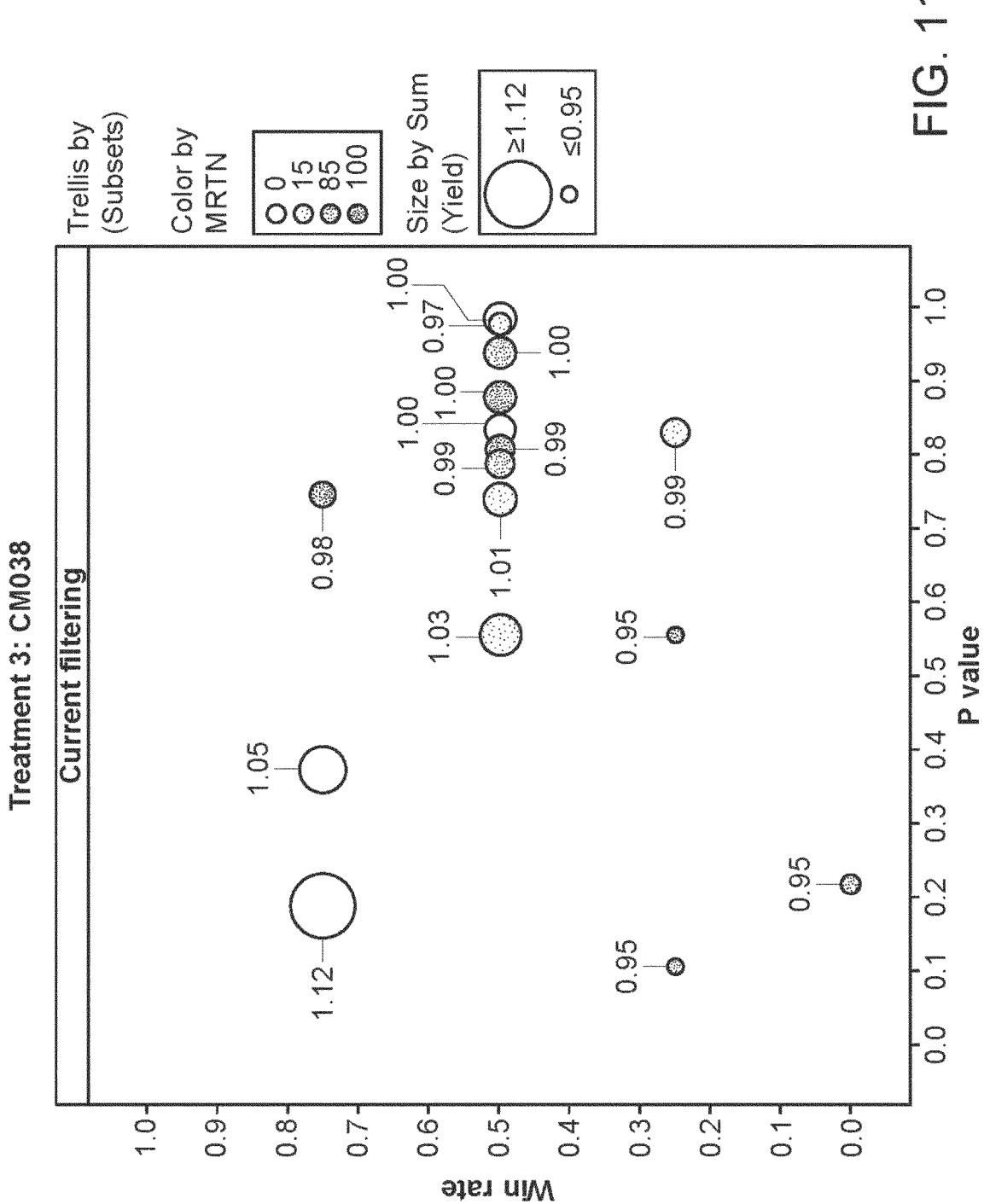
Figure 12:
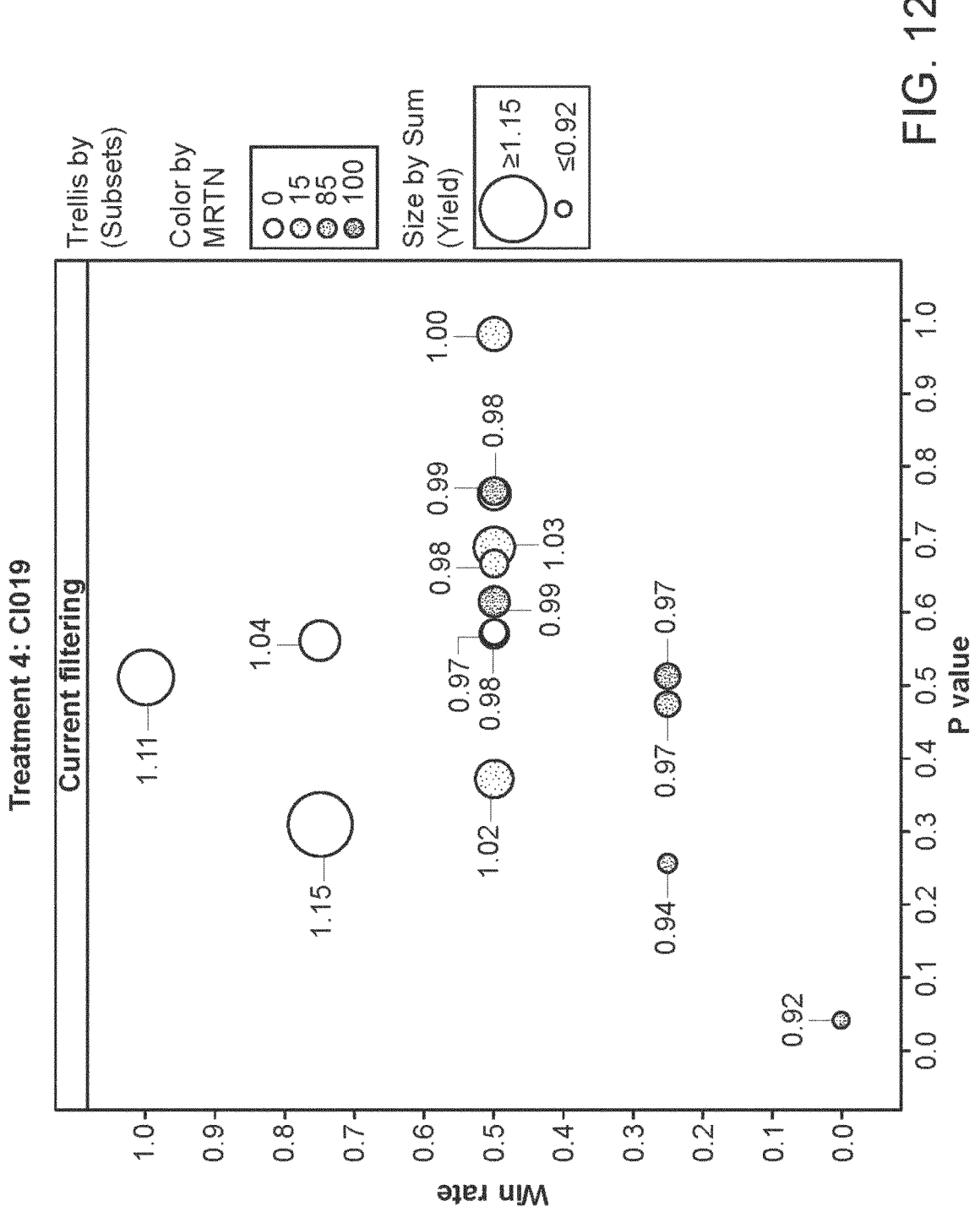
FIG. 12 depicts the plant yield of plants having been exposed to strain CI019. The area of the circles corresponds to the relative yield, while the shading corresponds to the particular MRTN treatment. The x-axis is the p value and the y-axis is the win rate.
Figure 13:
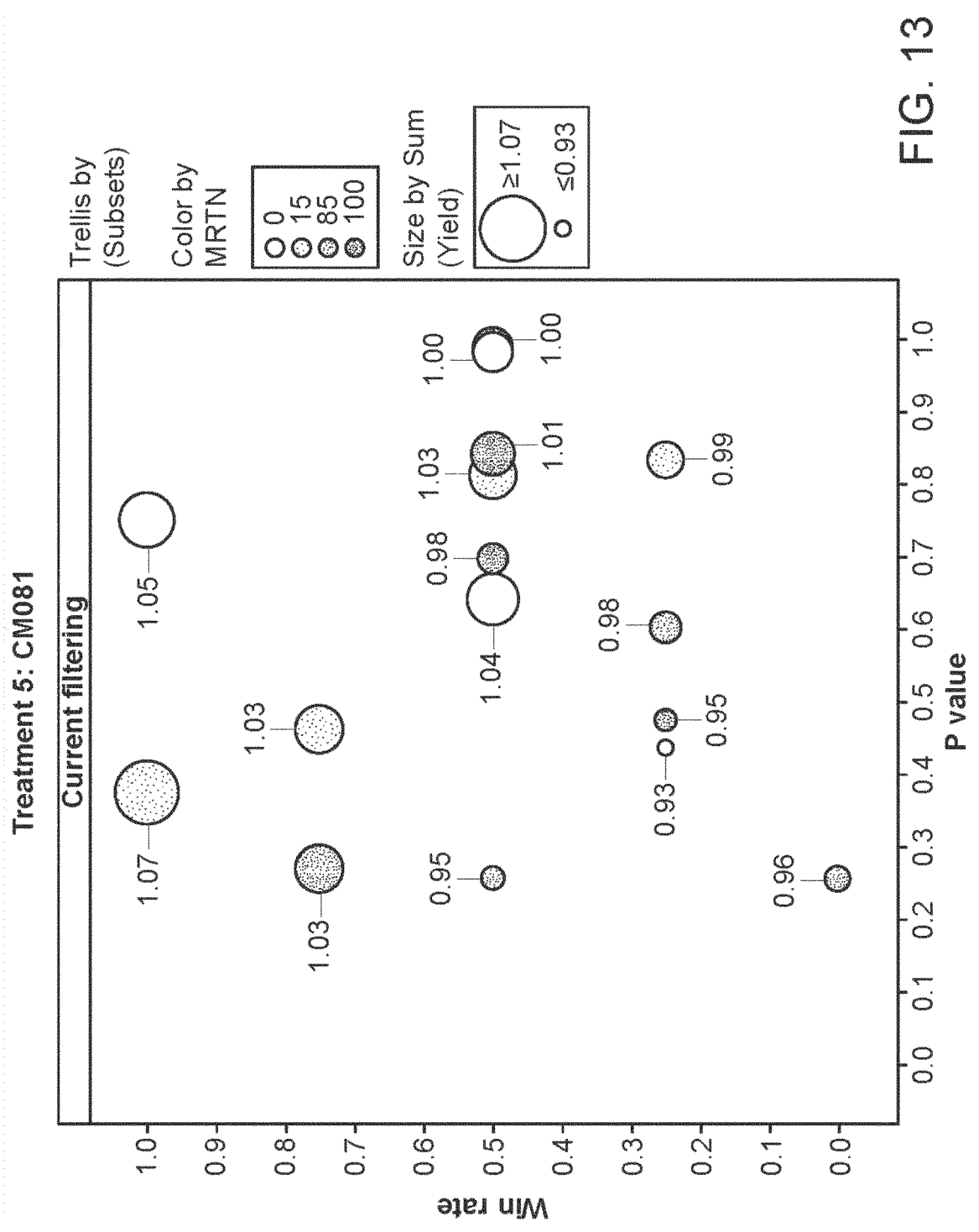
FIG. 13 depicts the plant yield of plants having been exposed to strain CM081. The area of the circles corresponds to the relative yield, while the shading corresponds to the particular MRTN treatment. The x-axis is the p value and the y-axis is the win rate.
Figure 14:
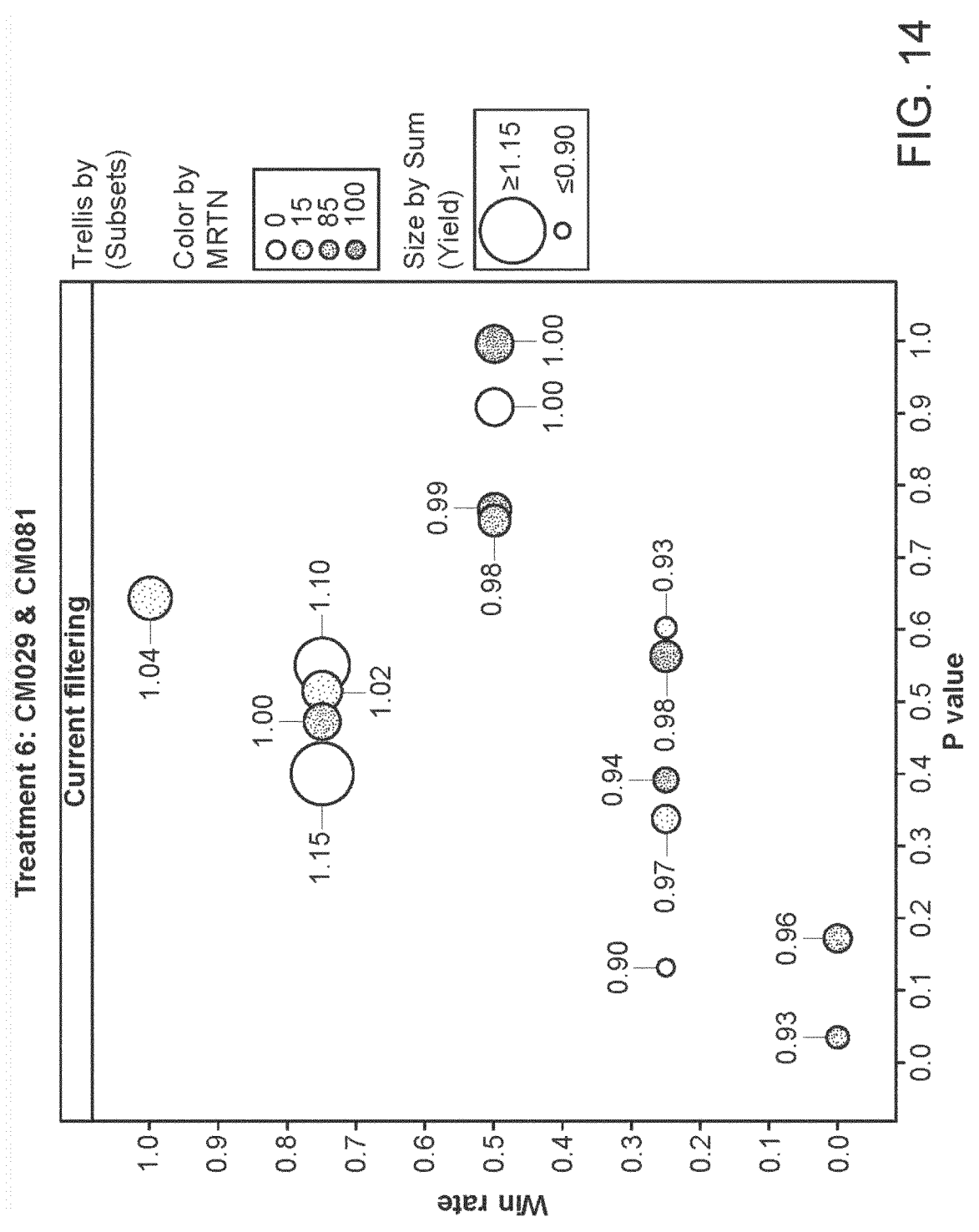
FIG. 14 depicts the plant yield of plants having been exposed to strains CM029 and CM081. The area of the circles corresponds to the relative yield, while the shading corresponds to the particular MRTN treatment. The x-axis is the p value and the y-axis is the win rate.
Figure 15:
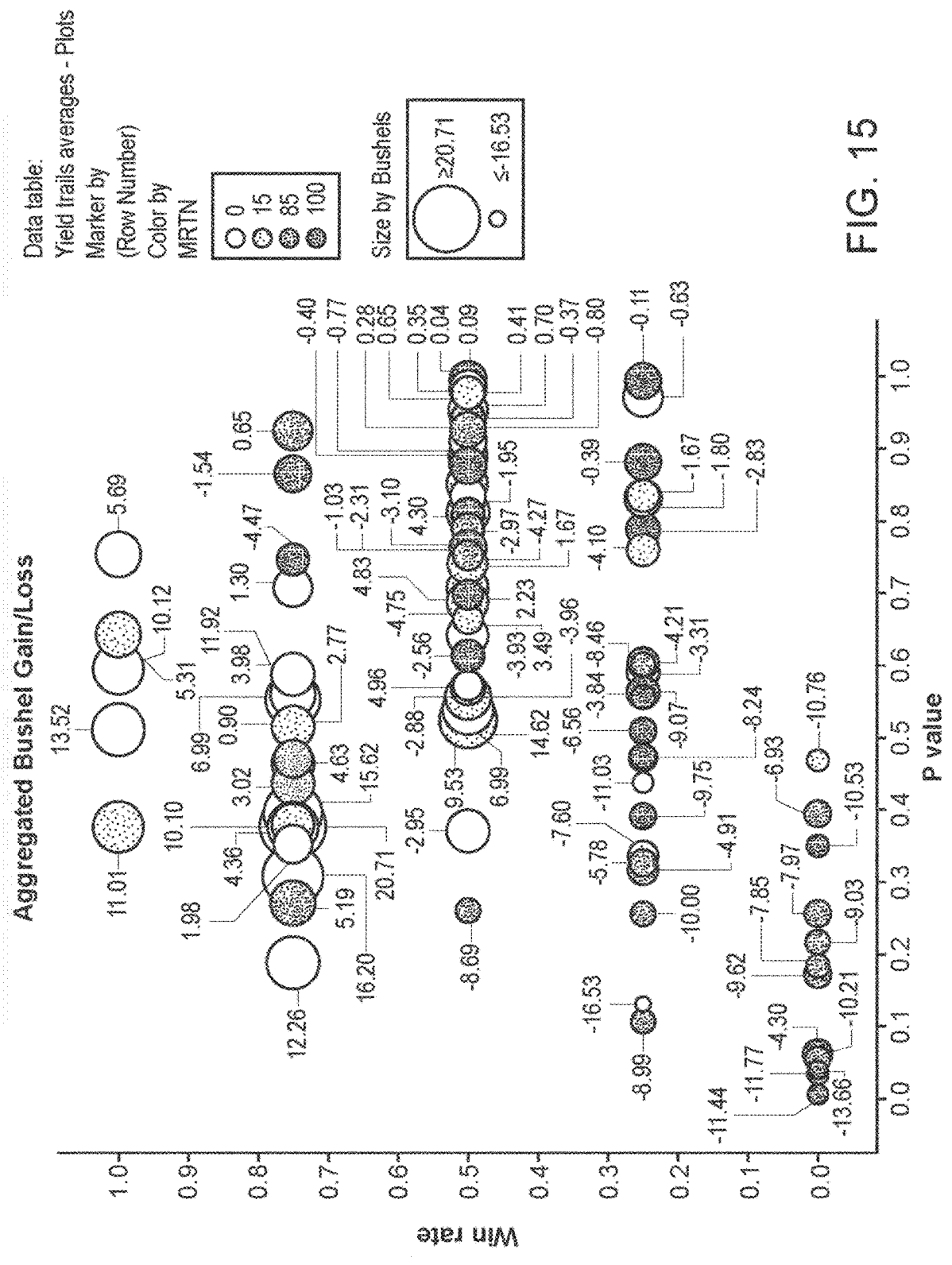
FIG. 15 depicts the plant yield of plants as the aggregated bushel gain/loss. The area of the circles corresponds to the relative yield, while the shading corresponds to the particular MRTN treatment. The x-axis is the p value and the y-axis is the win rate.
Figure 24:
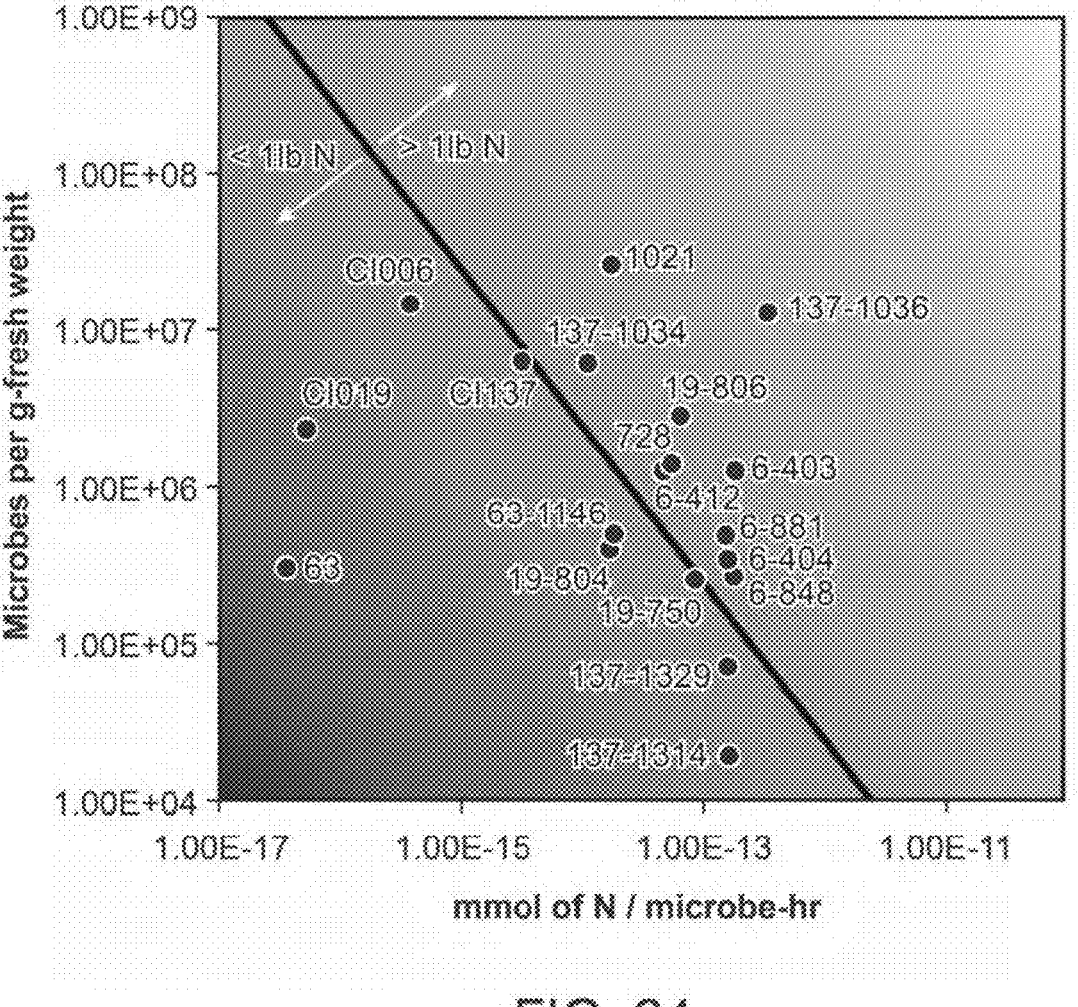
FIG. 24 depicts a heatmap of the pounds of nitrogen delivered per acre-season by microbes of the present disclosure recorded as a function of microbes per g-fresh weight by mmol of nitrogen/microbe-hr. Below the thin line that transects the larger image are the microbes that deliver less than one pound of nitrogen per acre-season, and above the line are the microbes that deliver greater than one pound of nitrogen per acre-season. The Table 28 in Example 5 gives the precise value of mmol N produced per microbe per hour (mmol N/Microbe hr) along with the precise CFU per gram of fresh weight (CFU/g fw) for each microbe shown in the heatmap. The data in FIG. 24 is derived from microbial strains assayed for N production in corn in field conditions. Each point represents lb N/acre produced by a microbe using corn root colonization data from a single field site. N-fixation activity was determined using in vitro ARA assay at 5 mM N in the form of glutamine or ammonium phosphate.
Figure 25:
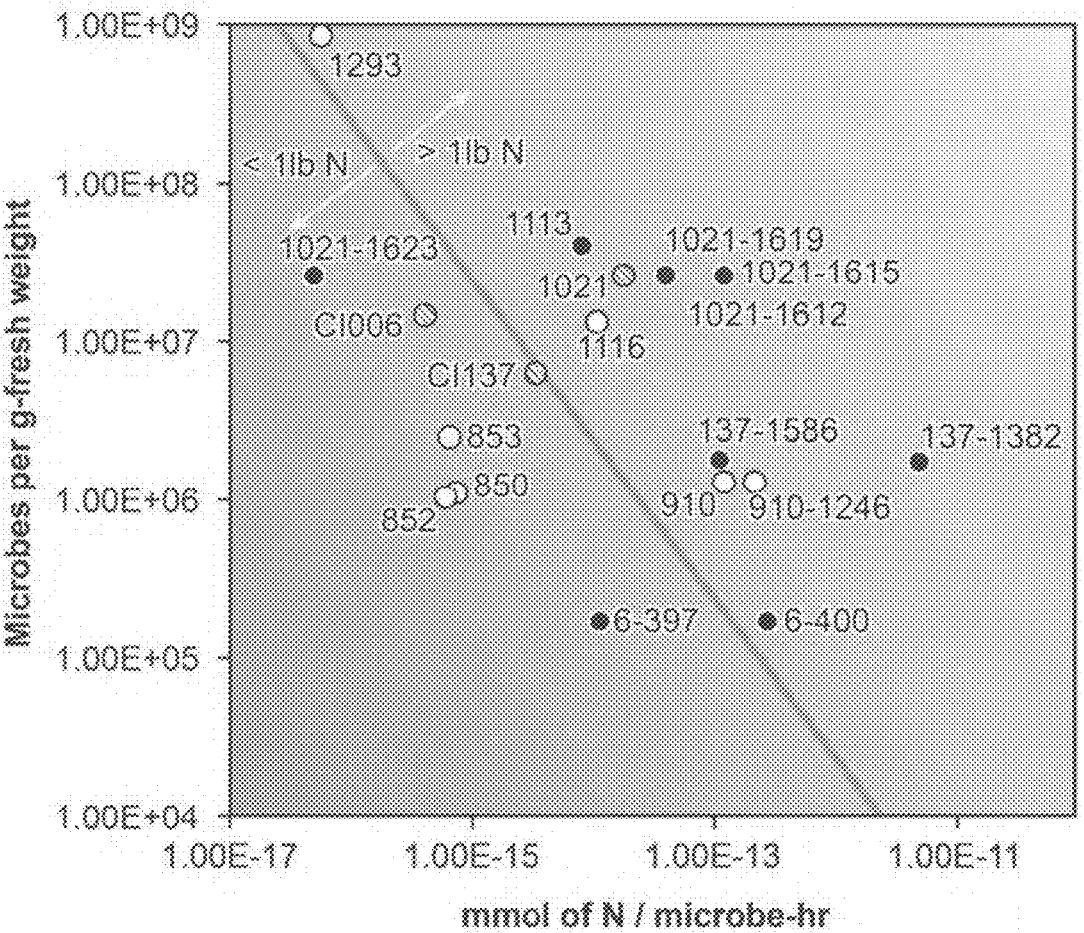
FIG. 25 depicts a heatmap of the pounds of nitrogen delivered per acre-season by microbes of the present disclosure recorded as a function of microbes per g-fresh weight by mmol of nitrogen/microbe-hr. Below the thin line that transects the larger image are the microbes that deliver less than one pound of nitrogen per acre-season, and above the line are the microbes that deliver greater than one pound of nitrogen per acre-season. The Table 29 in Example 5 gives the precise value of mmol N produced per microbe per hour (mmol N/Microbe hr) along with the precise CFU per gram of fresh weight (CFU/g fw) for each microbe shown in the heatmap. The data in FIG. 25 is derived from microbial strains assayed for N production in corn in laboratory and greenhouse conditions. Each point represents lb N/acre produced by a single strain. White points represent strains in which corn root colonization data was gathered in greenhouse conditions. Black points represent mutant strains for which corn root colonization levels are derived from average field corn root colonization levels of the wild-type parent strain. Hatched points represent the wild type parent strains at their average field corn root colonization levels. In all cases, N-fixation activity was determined by in vitro ARA assay at 5 mM N in the form of glutamine or ammonium phosphate.

To that end, the inventors have surprisingly discovered a functional genus of microbes that are able to contribute, inter alia, to: increasing yields in non-leguminous crops; and/or lessening a farmer's dependence upon exogenous nitrogen application; and/or the ability to produce at least one pound of nitrogen per acre per season, even in non-nitrogen-limiting environments, said genus being defined by the product of colonization ability× mmol of N produced per microbe per hour (i.e. the line partitioning FIGS. 8, 24, and 25).

With respect to FIGS. 8, 24, and 25, certain data utilizing microbes of the disclosure was aggregated, in order to depict a heatmap of the pounds of nitrogen delivered per acre-season by microbes of the disclosure, which are recorded as a function of microbes per g-fresh weight by mmol of nitrogen/microbe-hr. Below the thin line that transects the larger images are the microbes that deliver less than one pound of nitrogen per acre-season, and above the line are the microbes that deliver greater than one pound of nitrogen per acre-season.

Field Data & Wild Type Colonization Heatmap: The microbes utilized in the FIG. 8 heatmap were assayed for N production in corn. For the WT strains CI006 and CI019, corn root colonization data was taken from a single field site. For the remaining strains, colonization was assumed to be the same as the WT field level. N-fixation activity was determined using an in vitro ARA assay at 5 mM glutamine. The table below the heatmap in FIG. 8 gives the precise value of mmol N produced per microbe per hour (mmol N/Microbe hr) along with the precise CFU per gram of fresh weight (CFU/g fw) for each microbe shown in the heatmap.

Field Data Heatmap: The data utilized in the FIG. 24 heatmap is derived from microbial strains assayed for N production in corn in field conditions. Each point represents lb N/acre produced by a microbe using corn root colonization data from a single field site. N-fixation activity was determined using in vitro ARA assay at 5 mM N in the form of glutamine or ammonium phosphate. The below Table 28 gives the precise value of mmol N produced per microbe per hour (mmol N/Microbe hr) along with the precise CFU per gram of fresh weight (CFU/g fw) for each microbe shown in the heatmap of FIG. 24.

Greenhouse & Laboratory Data Heatmap: The data utilized in the FIG. 25 heatmap is derived from microbial strains assayed for N production in corn in laboratory and greenhouse conditions. Each point represents lb N/acre produced by a single strain. White points represent strains in which corn root colonization data was gathered in greenhouse conditions. Black points represent mutant strains for which corn root colonization levels are derived from average field corn root colonization levels of the wild-type parent strain. Hatched points represent the wild type parent strains at their average field corn root colonization levels. In all cases, N-fixation activity was determined by in vitro ARA assay at 5 mM N in the form of glutamine or ammonium phosphate. The below Table 29 gives the precise value of mmol N produced per microbe per hour (mmol N/Microbe hr) along with the precise CFU per gram of fresh weight (CFU/g fw) for each microbe shown in the heatmap of FIG. 25.

TABLE 28

| | FIG. 24-Field Data Heatmap | | | |
|---|---|---|---|---|
| Strain Name | Activity (mmol N/ Microbe hr) | Peak Colonization (CFU/g fw) | N Produced/ acre season | Taxonomic Designation |
| CI006 | 3.88E−16 | 1.50E+07 | 0.24 | *Kosakonia sacchari* |
| 6-404 | 1.61E−13 | 3.50E+05 | 2.28 | *Kosakonia sacchari* |
| 6-848 | 1.80E−13 | 2.70E+05 | 1.97 | *Kosakonia sacchari* |
| 6-881 | 1.58E−13 | 5.00E+05 | 3.20 | *Kosakonia sacchari* |
| 6-412 | 4.80E−14 | 1.30E+06 | 2.53 | *Kosakonia sacchari* |
| 6-403 | 1.90E−13 | 1.30E+06 | 10.00 | *Kosakonia sacchari* |
| CI019 | 5.33E−17 | 2.40E+06 | 0.01 | *Rahnella aquatilis* |
| 19-806 | 6.65E−14 | 2.90E+06 | 7.80 | *Rahnella aquatilis* |
| 19-750 | 8.90E−14 | 2.60E+05 | 0.94 | *Rahnella aquatilis* |
| 19-804 | 1.72E−14 | 4.10E+05 | 0.29 | *Rahnella aquatilis* |
| CI137 | 3.24E−15 | 6.50E+06 | 0.85 | *Klebsiella variicola* |
| 137-1034 | 1.16E−14 | 6.30E+06 | 2.96 | *Klebsiella variicola* |
| 137-1036 | 3.47E−13 | 1.30E+07 | 182.56 | *Klebsiella variicola* |
| 137-1314 | 1.70E−13 | 1.99E+04 | 0.14 | *Klebsiella variicola* |
| 137-1329 | 1.65E−13 | 7.25E+04 | 0.48 | *Klebsiella variicola* |
| 63 | 3.60E−17 | 3.11E+05 | 0.00 | *Rahnella aquatilis* |
| 63-1146 | 1.90E−14 | 5.10E+05 | 0.39 | *Rahnella aquatilis* |
| 1021 | 1.77E−14 | 2.69E+07 | 19.25 | *Kosakonia pseudosacchari* |
| 728 | 5.56E−14 | 1445240.09 | 3.25 | *Klebsiella variicola* |

TABLE 29

| | FIG. 25-Greenhouse & Laboratory Data Heatmap | | | |
|---|---|---|---|---|
| Strain Name | Activity (mmol N/ Microbe hr) | Peak Colonization (CFU/g fw) | N Produced/ acre season | Taxonomic Designation |
| CI006 | 3.88E−16 | 1.50E+07 | 0.24 | *Kosakonia sacchari* |
| 6-400 | 2.72E−13 | 1.79E+05 | 1.97 | *Kosakonia sacchari* |
| 6-397 | 1.14E−14 | 1.79E+05 | 0.08 | *Kosakonia sacchari* |
| CI137 | 3.24E−15 | 6.50E+06 | 0.85 | *Klebsiella variicola* |
| 137-1586 | 1.10E−13 | 1.82E+06 | 8.10 | *Klebsiella variicola* |
| 137-1382 | 4.81E−12 | 1.82E+06 | 354.60 | *Klebsiella variicola* |

TABLE 29-continued

| | FIG. 25-Greenhouse & Laboratory Data Heatmap | | | |
|---|---|---|---|---|
| Strain Name | Activity (mmol N/ Microbe hr) | Peak Colonization (CFU/g fw) | N Produced/ acre season | Taxonomic Designation |
| 1021 | 1.77E−14 | 2.69E+07 | 19.25 | *Kosakonia pseudosacchari* |
| 1021-1615 | 1.20E−13 | 2.69E+07 | 130.75 | *Kosakonia pseudosacchari* |
| 1021-1619 | 3.93E−14 | 2.69E+07 | 42.86 | *Kosakonia pseudosacchari* |
| 1021-1612 | 1.20E−13 | 2.69E+07 | 130.75 | *Kosakonia pseudosacchari* |
| 1021-1623 | 4.73E−17 | 2.69E+07 | 0.05 | *Kosakonia pseudosacchari* |
| 1293 | 5.44E−17 | 8.70E+08 | 1.92 | *Azospirillum lipoferum* |
| 1116 | 1.05E−14 | 1.37E+07 | 5.79 | *Enterobacter* sp. |
| 1113 | 8.05E−15 | 4.13E+07 | 13.45 | *Enterobacter* sp. |
| 910 | 1.19E−13 | 1.34E+06 | 6.46 | *Kluyvera intermedia* |
| 910-1246 | 2.16E−13 | 1.34E+06 | 11.69 | *Kluyvera intermedia* |
| 850 | 7.2301E−16 | 1.17E+06 | 0.03 | *Achromobacter spiritinus* |
| 852 | 5.96E−16 | 1.07E+06 | 0.03 | *Achromobacter marplatensis* |
| 853 | 6.42E−16 | 2.55E+06 | 0.07 | *Microbacterium murale* |

Conclusions: The data in FIGS. 8, 24, 25, and Tables 28 and 29, illustrates more than a dozen representative members of the described genus (i.e. microbes to the right of the line in the figures). Further, these numerous representative members come from a diverse array of taxonomic genera, which can be found in the above Tables 28 and 29. Further still, the inventors have discovered numerous genetic attributes that depict a structure/function relationship that is found in many of the microbes. These genetic relationships can be found in the numerous tables of the disclosure setting forth the genetic modifications introduced by the inventors, which include introducing at least one genetic variation into at least one gene, or non-coding polynucleotide, of the nitrogen fixation or assimilation genetic regulatory network.

Consequently, the newly discovered genus is supported by: (1) a robust dataset, (2) over a dozen representative members, (3) members from diverse taxonomic genera, and (4) classes of genetic modifications that define a structure/function relationship, in the underlying genetic architecture of the genus members.

Example 6: Methods and Assays for Detection of Non-Intergeneric Remodeled Microbes The present disclosure teaches primers, probes, and assays that are useful for detecting the microbes utilized in the various aforementioned Examples. The assays are able to detect the non-natural nucleotide "junction" sequences in the derived/mutant non-intergeneric remodeled microbes. These non-naturally occurring nucleotide junctions can be used as a type of diagnostic that is indicative of the presence of a particular genetic alteration in a microbe.

The present techniques are able to detect these non-naturally occurring nucleotide junctions via the utilization of specialized quantitative PCR methods, including uniquely designed primers and probes. The probes can bind to the non-naturally occurring nucleotide junction sequences. That is, sequence-specific DNA probes consisting of oligonucleotides that are labelled with a fluorescent reporter, which permits detection only after hybridization of the probe with its complementary sequence can be used. The quantitative methods can ensure that only the non-naturally occurring nucleotide junction will be amplified via the taught primers, and consequently can be detected via either a non-specific dye, or via the utilization of a specific hybridization probe. Another aspect of the method is to choose primers such that the primers flank either side of a junction sequence, such that if an amplification reaction occurs, then said junction sequence is present.

Consequently, genomic DNA can be extracted from samples and used to quantify the presence of microbes of the disclosure by using qPCR. The primers utilized in the qPCR reaction can be primers designed by Primer Blast (www.ncbi.nlm.nih.gov/tools/primer-blast/) to amplify unique regions of the wild-type genome or unique regions of the engineered non-intergeneric mutant strains. The qPCR reaction can be carried out using the SYBR GreenER qPCR SuperMix Universal (Thermo Fisher P/N 11762100) kit, using only forward and reverse amplification primers; alternatively, the Kapa Probe Force kit (Kapa Biosystems P/N KK4301) can be used with amplification primers and a TaqMan probe containing a FAM dye label at the 5′ end, an internal ZEN quencher, and a minor groove binder and fluorescent quencher at the 3′ end (Integrated DNA Technologies).

Certain primer, probe, and non-native junction sequences—which can be used in the qPCR methods—are listed in the below Table 30. Specifically, the non-native junction sequences can be found in SEQ ID NOs: 372-405 and 425-430.

TABLE 30

| base CI | Junction Name | up/ down stream junction | SEQ ID NO | 100 bp upstream of junction | SEQ ID NO | 100 bp downstream of junction | SEQ ID NO | Junction SEQ "/" indicating junction | Junction des. | F primer SEQ | R primer SEQ | Probe SEQ |
|---|---|---|---|---|---|---|---|---|---|---|---|---|
| | | | | Microbial Detection | | | | | | | | |
| 1021 | ds1131 | up | 304 | TGGTGTCCGGGC GAACGTCGCCAG GTGGCACAAATT | 338 | TTCTTGGTTCTCT GGAGCGCTTTAT CGGCATCCTGAC | 372 | 5′- TGGTGTCCGGGC GAACGTCGCCAG | disrupted nifL gene/ PinfC | N/A | N/A | N/A |

TABLE 30-continued

Microbial Detection

| base CI | Junc-tion Name | up/down stream junc-tion | SEQ ID NO | 100 bp upstream of junction | SEQ ID NO | 100 bp downstream of junction | SEQ ID NO | Junction "/" indicating junction | Junction des. | F primer SEQ | R primer SEQ | Probe SEQ |
|---|---|---|---|---|---|---|---|---|---|---|---|---|
| | | | | GTCAGAACTACG ACACGACTAACC GACCGCAGGAGT GTGCGATGACCC TGAATATGATGA TGGA | | TGAAGAATTTGC AGGCTTCTTCCCA ACCTGGCTTGCA CCCGTGCAGGTA GTTGTGATGAAC AT | | GTGGCACAAATT GTCAGAACTACG ACACGACTAACC GACCGCAGGAGT GTGCGATGACCC TGAATATGATGA TGGA/ TTCTTGGTTCTC TGGAGCGCTTTA TCGGCATCCTGA CTGAAGAATTTG CAGGCTTCTTCC CAACCTGGCTTG CACCCGTGCAGG TAGTTGTGATGA ACAT-3' | | | | |
| 1021 | ds1131 | down | 305 | CGGAAAACGAGT TCAAACGGCGCG TCCCAATCGTATT AATGGCGAGATT CGCGCCACGGAA GTTCGCTTAACAG GTCTGGAAGGCG AGCAGCTTGGTA TT | 339 | GCGATAGAACTC ACTTCACGCCCC GAAGGGGGAAGC TGCCTGACCCTAC GATTCCCGCTATT TCATTCACTGACC GGAGGTTCAAAA TGACCCAGCGAA C | 373 | 5'- CGGAAAACGAGT TCAAACGGCGCG TCCCAATCGTAT TAATGGCGAGAT TCGCGCCACGGA AGTTCGCTTAAC AGGTCTGGAAGG CGAGCAGCTTGG TATT/ GCGATAGAACTC ACTTCACGCCCC GAAGGGGGAAGC TGCCTGACCCTA CGATTCCCGCTA TTTCATTCACTG ACCGGAGGTTCA AAATGACCCAGC GAAC-3' | PinfC/ disrupted nifL gene | N/A | N/A | N/A |
| 1021 | ds1133 | N/A | 306 | CGCCAGAGAGTT GAAATCGAACAT TTCCGTAATACCG CCATTACCCAGG AGCCGTTCTGGTT GCACAGCGGAAA ACGTTAACGAAA GGATATTTCGCAT G | 340 | TCCCTGTGCGCCG CGTCGCCGATGG TGGCCAGCCAAC TGGCGCGCTACC CGATCCTGCTCG ATGAACTGCTCG ACCCGAACACGC TCTATCAACCGA CGG | 374 | 5'- CGCCAGAGAGTT GAAATCGAACAT TTCCGTAATACC GCCATTACCCAG GAGCCGTTCTGG TTGCACAGCGGA AAACGTTAACGA AAGGATATTTCG CATG/ TCCCTGTGCGCC GCGTCGCCGATG GTGGCCAGCCAA CTGGCGCGCTAC CCGATCCTGCTC GATGAACTGCTC GACCCGAACACG CTCTATCAACCG ACGG-3' | 5' UTR and ATG/ truncated glnE gene | N/A | N/A | N/A |
| 1021 | ds1145 | up | 307 | CGGGCGAACGTC GCCAGGTGGCAC AAATTGTCAGAA CTACGACACGAC TAACCGACCGCA GGAGTGTGCGAT GACCCTGAATAT GATGATGGATGC CAGC | 341 | CGTTCTGTAATAA TAACCGGACAAT TCGGACTGATTA AAAAAGCGCCCT CGCGGCGCTTTTT TTATATTCTCGAC TCCATTTAAAATA AAAAATCCAATC | 375 | 5'- CGGGCGAACGTC GCCAGGTGGCAC AAATTGTCAGAA CTACGACACGAC TAACCGACCGCA GGAGTGTGCGAT GACCCTGAATAT GATGATGGATGC CAGC/ CGTTCTGTAATA ATAACCGGACAA TTCGGACTGATT AAAAAAGCGCCC TCGCGGCGCTTT | disrupted nifL gene/ Prm1 | N/A | N/A | N/A |

TABLE 30-continued

Microbial Detection

| base CI | Junction Name | up/ down stream junction | SEQ ID NO | 100 bp upstream of junction | SEQ ID NO | 100 bp downstream of junction | SEQ ID NO | Junction "/" indicating junction | Junction des. | F primer SEQ | R primer SEQ | Probe SEQ |
|---|---|---|---|---|---|---|---|---|---|---|---|---|
| | | | | | | | | TTTTATATTCTC GACTCCATTTAA AATAAAAAATCC AATC-3' | | | | |
| 1021 | ds1145 | down | 308 | TCAACCTAAAAA AGTTTGTGTAATA CTTGTAACGCTAC ATGGAGATTAAC TCAATCTAGAGG GTATTAATAATG AATCGTACTAAA CTGGTACTGGGC GC | 342 | AACTCACTTCAC GCCCCGAAGGGG GAAGCTGCCTGA CCCTACGATTCCC GCTATTTCATTCA CTGACCGGAGGT TCAAAATGACCC AGCGAACCGAGT CG | 376 | 5'- TCAACCTAAAAA AGTTTGTGTAAT ACTTGTAACGCT ACATGGAGATTA ACTCAATCTAGA GGGTATTAATAA TGAATCGTACTA AACTGGTACTGG GCGC/ AACTCACTTCAC GCCCCGAAGGGG GAAGCTGCCTGA CCCTACGATTCC CGCTATTTCATT CACTGACCGGAG GTTCAAAATGAC CCAGCGAACCGA GTCG-3' | Prm1/ disrupted nifL gene | N/A | N/A | N/A |
| 1021 | ds1148 | up | 309 | CGGGCGAACGTC GCCAGGTGGCAC AAATTGTCAGAA CTACGACACGAC TAACCGACCGCA GGAGTGTGCGAT GACCCTGAATAT GATGATGGATGC CAGC | 343 | CGCGTCAGGTTG AACGTAAAAAAG TCGGTCTGCGCA AAGCACGTCGTC GTCCGCAGTTCTC CAAACGTTAATT GGTTTCTGCTTCG GCAGAACGATTG GC | 375 | 5'- CGGGCGAACGTC GCCAGGTGGCAC AAATTGTCAGAA CTACGACACGAC TAACCGACCGCA GGAGTGTGCGAT GACCCTGAATAT GATGATGGATGC CAGC/ CGCGTCAGGTTG AACGTAAAAAAG TCGGTCTGCGCA AAGCACGTCGTC GTCCGCAGTTCT CCAAACGTTAAT TGGTTTCTGCTT CGGCAGAACGAT TGGC-3' | disrupted nifL gene/ Prm7 | N/A | N/A | N/A |
| 1021 | ds1148 | down | 310 | AATTTTCTGCCCA AATGGCTGGGAT TGTTCATTTTTTG TTTGCCTTACAAC GAGAGTGACAGT ACGCGCGGGTAG TTAACTCAACATC TGACCGGTCGAT | 344 | AACTCACTTCAC GCCCCGAAGGGG GAAGCTGCCTGA CCCTACGATTCCC GCTATTTCATTCA CTGACCGGAGGT TCAAAATGACCC AGCGAACCGAGT CG | 378 | 5'- AATTTTCTGCCC AAATGGCTGGGA TTGTTCATTTTT TGTTTGCCTTAC AACGAGAGTGAC AGTACGCGCGGG TAGTTAACTCAA CATCTGACCGGT CGAT/ AACTCACTTCAC GCCCCGAAGGGG GAAGCTGCCTGA CCCTACGATTCC CGCTATTTCATT CACTGACCGGAG GTTCAAAATGAC CCAGCGAACCGA GTCG-3' | Prm4/ disrupted nifL gene | N/A | N/A | N/A |
| CI006 | ds126 | N/A | 311 | GTAACCAATAAA GGCCACCACGCC AGACCACACGAT AGTGATGGCAAC ACTTTCCAGCTGC ACCAGCACCTGA TGGCCCATGGTC | 345 | CCGATCCCCATC ACTGTGTGTCTTG TATTACAGTGCC GCTTCGTCGGCTT CGCCGGTACGAA TACGAATGACGC GTTGCAGCTCAG | 379 | 5'- GTAACCAATAAA GGCCACCACGCC AGACCACACGAT AGTGATGGCAAC ACTTTCCAGCTG CACCAGCACCTG | 5' UTR up to ATG- 4 bp of amtB gene/ disrupted amtB gene | N/A | N/A | N/A |

TABLE 30-continued

Microbial Detection

| base CI | Junction Name | up/down stream junction | SEQ ID NO | 100 bp upstream of junction | SEQ ID NO | 100 bp downstream of junction | SEQ ID NO | Junction "/" indicating junction | Junction des. | F primer SEQ | R primer SEQ | Probe SEQ |
|---|---|---|---|---|---|---|---|---|---|---|---|---|
| | | | | ACACCTTCAGCG AAA | | CAACGAAAATTT TG | | 5'- ATGGCCCATGGT CACACCTTCAGC GAAA/ CCGATCCCCATC ACTGTGTGTCTT GTATTACAGTGC CGCTTCGTCGGC TTCGCCGGTACG AATACGAATGAC GCGTTGCAGCTC AGCAACGAAAAT TTTG-3' | | | | |
| CI019 | ds172 | down | 312 | TGGTATTGTCAGT CTGAATGAAGCT CTTGAAAAAGCT GAGGAAGCGGGC GTCGATTTAGTAG AAATCAGTCCGA ATGCCGAGCCGC CAGTTTGTCGAAT C | 346 | CCGTCTCTGAAG CTCTCGGTGAAC ATTGTTGCGAGG CAGGATGCGAGC TGGTTGTGTTTTG ACATTACCGATA ATGTGCCGCGTG AACGGGTGCGTT ATG | 380 | 5'- TGGTATTGTCAG TCTGAATGAAGC TCTTGAAAAAGC TGAGGAAGCGGG CGTCGATTTAGT AGAAATCAGTCC GAATGCCGAGCC GCCAGTTTGTCG AATC/ CCGTCTCTGAAG CTCTCGGTGAAC ATTGTTGCGAGG CAGGATGCGAGC TGGTTGTGTTTT GACATTACCGAT AATGTGCCGCGT GAACGGGTGCGT TATG-3' | Prm1.2/ disrupted nifL gene | SEQ ID NO: 406 CAAG AAGT TCGC CTCA CAGG | SEQ ID NO: 407 TGCC TCGC AACA ATGT TCAC | N/A |
| CI019 | ds172 | up | 313 | ACCGATCCGCAG GCGCGCATTTGTT ATGCCAATCCGG CATTCTGCCGCCA GACGGGTTTTGC ACTTGAGACACTT TTGGGCGAGAAC CACCGTCTGCTGG | 347 | TGAACATCACTG ATGCACAAGCTA CCTATGTCGAAG AATTAACTAAAA AACTGCAAGATG CAGGCATTCGCG TTAAAGCCGACT TGAGAAATGAGA AGAT | 381 | 5'- ACCGATCCGCAG GCGCGCATTTGT TATGCCAATCCG GCATTCTGCCGC CAGACGGGTTTT GCACTTGAGACA CTTTTTGGGCGAG AACCACCGTCTG CTGG/ TGAACATCACTG ATGCACAAGCTA CCTATGTCGAAG AATTAACTAAAA AACTGCAAGATG CAGGCATTCGCG TTAAAGCCGACT TGAGAAATGAGA AGAT-3' | disrupted nifL gene/ Prm1.2 | N/A | N/A | N/A |
| CI019 | ds175 | down | 314 | CGGGAACCGGTG TTATAATGCCGCG CCCTCATATTGTG GGGATTTCTTAAT GACCTATCCTGG GTCCTAAAGTTGT AGTTGACATTAG CGGAGCACTAAC | 348 | CCGTCTCTGAAG CTCTCGGTGAAC ATTGTTGCGAGG CAGGATGCGAGC TGGTTGTGTTTTG ACATTACCGATA ATGTGCCGCGTG AACGGGTGCGTT ATG | 382 | 5'- CGGGAACCGGTG TTATAATGCCGC GCCCTCATATTG TGGGGATTTCTT AATGACCTATCC TGGGTCCTAAAG TTGTAGTTGACA TTAGCGGAGCAC TAAC/ CCGTCTCTGAAG CTCTCGGTGAAC ATTGTTGCGAGG CAGGATGCGAGC TGGTTGTGTTTT GACATTACCGAT AATGTGCCGCGT GAACGGGTGCGT TATG-3' | Prm3.1/ disrupted nifL gene | SEQ ID NO: 408 CGCC CTCA TATT GTGG GGAT | SEQ ID NO: 409 GGCA TAAC GCAC CCGT TCA | SEQ ID NO: 410/ 56- FAM/ TA ACC CGT C/ ZEN/ TCTG AAG CTC TCG GT/ 3IAB kFQ/ |

TABLE 30-continued

Microbial Detection

| base CI | Junction Name | up/down stream junction | SEQ ID NO | 100 bp upstream of junction | SEQ ID NO | 100 bp downstream of junction | SEQ ID NO | Junction "/" indicating junction | Junction des. | F primer SEQ | R primer SEQ | Probe SEQ |
|---|---|---|---|---|---|---|---|---|---|---|---|---|
| CI019 | ds175 | up | 315 | ACCGATCCGCAG GCGCGCATTTGTT ATGCCAATCCGG CATTCTGCCGCCA GACGGGTTTTGC ACTTGAGACACTT TTGGGCGAGAAC CACCGTCTGCTGG | 349 | TACAGTAGCGCC TCTCAAAAATAG ATAAACGGCTCA TGTACGTGGGCC GTTTATTTTTTCT ACCCATAATCGG GAACCGGTGTTA TAATGCCGCGCC CTC | 383 | 5'-ACCGATCCGCAG GCGCGCATTTGT TATGCCAATCCG GCATTCTGCCGC CAGACGGGTTTT GCACTTGAGACA CTTTTGGGCGAG AACCACCGTCTG CTGG/ TACAGTAGCGCC TCTCAAAAATAG ATAAACGGCTCA TGTACGTGGGCC GTTTATTTTTTC TACCCATAATCG GGAACCGGTGTT ATAATGCCGCGC CCTC-3' | disrupted nifL gene/ Prm3.1 | N/A | N/A | N/A |
| CI006 | ds20 | down | 316 | TCAACCTAAAAA AGTTTGTGTAATA CTTGTAACGCTAC ATGGAGATTAAC TCAATCTAGAGG GTATTAATAATG AATCGTACTAAA CTGGTACTGGGC GC | 350 | AACTCACTTCAC ACCCCGAAGGGG GAAGTTGCCTGA CCCTACGATTCCC GCTATTTCATTCA CTGACCGGAGGT TCAAAATGACCC AGCGAACCGAGT CG | 384 | 5'-TCAACCTAAAAA AGTTTGTGTAAT ACTTGTAACGCT ACATGGAGATTA ACTCAATCTAGA GGGTATTAATAA TGAATCGTACTA AACTGGTACTGG GCGC/ AACTCACTTCAC ACCCCGAAGGGG GAAGTTGCCTGA CCCTACGATTCC CGCTATTTCATT CACTGACCGGAG GTTCAAAATGAC CCAGCGAACCGA GTCG-3' | Prm1/ disrupted nifL gene | SEQ ID NO: 411 TAAA CTGG TACT GGGC GCAA CT | SEQ ID NO: 412 CAAA TCGA AGCG CCAG ACGG TAT | SEQ ID NO: 413 /56-FAM/ AAG TTGC CT/ ZEN/ GACC CTAC GATT CCC/ 3IAB kFQ/ |
| CI006 | ds20 | up | 317 | GGGCGACAAACG GCCTGGTGGCAC AAATTGTCAGAA CTACGACACGAC TAACTGACCGCA GGAGTGTGCGAT GACCCTGAATAT GATGATGGATGC CGGC | 351 | CGTCCTGTAATA ATAACCGGACAA TTCGGACTGATTA AAAAGCGCCCT TGTGGCGCTTTT TTATATTCCCGCC TCCATTTAAAATA AAAAATCCAATC | 385 | 5'-GGGCGACAAACG GCCTGGTGGCAC AAATTGTCAGAA CTACGACACGAC TAACTGACCGCA GGAGTGTGCGAT GACCCTGAATAT GATGATGGATGC CGGC/ CGTCCTGTAATA ATAACCGGACAA TTCGGACTGATT AAAAAGCGCCC TTGTGGCGCTTT TTTATATTCCC GCCTCCATTTAA AATAAAAAATCC AATC-3' | disrupted nifL gene/ Prm1 | N/A | N/A | N/A |
| CI006 | ds24 | up | 318 | GGGCGACAAACG GCCTGGTGGCAC AAATTGTCAGAA CTACGACACGAC TAACTGACCGCA GGAGTGTGCGAT GACCCTGAATAT GATGATGGATGC CGGC | 352 | GGACATCATCGC GACAAACAATAT TAATACCGGCAA CCACACCGGCAA TTTACGAGACTG CGCAGGCATCCT TTCTCCCGTCAAT TTCTGTCAAATAA AG | 386 | 5'-GGGCGACAAACG GCCTGGTGGCAC AAATTGTCAGAA CTACGACACGAC TAACTGACCGCA GGAGTGTGCGAT GACCCTGAATAT GATGATGGATGC CGGC/ GGACATCATCGC | disrupted nifL gene/ Prm5 | SEQ ID NO: 414 GGTG CACT CTTT GCAT GGTT | SEQ ID NO: 415 GCGC AGTC TCGT AAAT TGCC | SEQ ID NO: 416 /56- FAM/ CA GGA GTG T/ ZEN/ |

TABLE 30-continued

Microbial Detection

| base CI | Junc- tion Name | up/ down stream junc- tion | SEQ ID NO | 100 bp upstream of junction | SEQ ID NO | 100 bp downstream of junction | SEQ ID NO | Junction "/" indicating junction | Junction des. | F primer SEQ | R primer SEQ | Probe SEQ |
|---|---|---|---|---|---|---|---|---|---|---|---|---|
| | | | | | | | | GACAAACAATAT TAATACCGGCAA CCACACCGGCAA TTTACGAGACTG CGCAGGCATCCT TTCTCCCGTCAA TTTCTGTCAAAT AAAG-3' | | | | GCGA TGA CCC TGA AT/ 3IAB kFQ |
| CI006 | ds24 | down | 319 | TAAGAATTATCTG GATGAATGTGCC ATTAAATGCGCA GCATAATGGTGC GTTGTGCGGGAA AACTGCTTTTTTT TGAAAGGGTTGG TCAGTAGCGGAA AC | 353 | AACTCACTTCAC ACCCCGAAGGGG GAAGTTGCCTGA CCCTACGATTCCC GCTATTTCATTCA CTGACCGGAGGT TCAAAATGACCC AGCGAACCGAGT CG | 387 | 5'- TAAGAATTATCT GGATGAATGTGC CATTAAATGCGC AGCATAATGGTG CGTTGTGCGGGA AAACTGCTTTTT TTTGAAAGGGTT GGTCAGTAGCGG AAAC/ AACTCACTTCAC ACCCCGAAGGGG GAAGTTGCCTGA CCCTACGATTCC CGCTATTTCATT CACTGACCGGAG GTTCAAAATGAC CCAGCGAACCGA GTCG-3' | Prm5/ disrupted nifL gene | N/A | N/A | N/A |
| CI006 | ds30 | N/A | 320 | CGCCAGAGAGTC GAAATCGAACAT TTCCGTAATACCG CGATTACCCAGG AGCCGTTCTGGTT GCACAGCGGAAA ACGTTAACGAAA GGATATTTCGCAT G | 354 | TTTAACGATCTGA TTGGCGATGATG AAACGGATTCGC CGGAAGATGCGC TTTCTGAGAGCTG GCGCGAATTGTG GCAGGATGCGTT GCAGGAGGAGGA TT | 388 | 5'- CGCCAGAGAGTC GAAATCGAACAT TTCCGTAATACC GCGATTACCCAG GAGCCGTTCTGG TTGCACAGCGGA AAACGTTAACGA AAGGATATTTCG CATG/ TTTAACGATCTG ATTGGCGATGAT GAAACGGATTCG CCGGAAGATGCG CTTTCTGAGAGC TGGCGCGAATTG TGGCAGGATGCG TTGCAGGAGGAG GATT-3' | 5' UTR and ATG/ truncated glnE gene | N/A | N/A | N/A |
| CI006 | ds31 | N/A | 321 | CGCCAGAGAGTC GAAATCGAACAT TTCCGTAATACCG CGATTACCCAGG AGCCGTTCTGGTT GCACAGCGGAAA ACGTTAACGAAA GGATATTTCGCAT G | 355 | GCACTGAAACAC CTCATTTCCCTGT GTGCCGCGTCGC CGATGGTTGCCA GTCAGCTGGCGC GCTACCCGATCCT GCTTGATGAATT GCTCGACCCGAA TA | 389 | 5'- CGCCAGAGAGTC GAAATCGAACAT TTCCGTAATACC GCGATTACCCAG GAGCCGTTCTGG TTGCACAGCGGA AAACGTTAACGA AAGGATATTTCG CATG/ GCACTGAAACAC CTCATTTCCCTG TGTGCCGCGTCG CCGATGGTTGCC AGTCAGCTGGCG CGCTACCCGATC CTGCTTGATGAA TTGCTCGACCCG AATA-3' | 5' UTR and ATG/ truncated glnE gene | N/A | N/A | N/A |
| CI019 | ds34 | N/A | 322 | GATGATGGATGC TTTCTGGTTAAAC GGGCAACCTCGT | 356 | GCGCTCAAACAG TTAATCCGTCTGT GTGCCGCCTCGC | 390 | 5'- GATGATGGATGC TTTCTGGTTAAA | 5' UTR and ATG/ truncated | | | |

TABLE 30-continued

Microbial Detection

| base CI | Junction Name | up/ down stream junc- tion | SEQ ID NO | 100 bp upstream of junction | SEQ ID NO | 100 bp downstream of junction | SEQ ID NO | Junction "/" indicating junction | Junction des. | F primer SEQ | R primer SEQ | Probe SEQ |
|---|---|---|---|---|---|---|---|---|---|---|---|---|
| | | | | TAACTGACTGACT AGCCTGGGCAAA CTGCCCGGGCTTT TTTTTGCAAGGAA TCTGATTTCATG | | CGATGGTCGCGA CACAACTTGCAC GTCATCCTTTATT GCTCGATGAACT GCTCGACCCGCG CA | | CGGGCAACCTCG TTAACTGACTGA CTAGCCTGGGCA AACTGCCCGGGC TTTTTTTTGCAA GGAATCTGATTT CATG/ GCGCTCAAACAG TTAATCCGTCTG TGTGCCGCCTCG CCGATGGTCGCG ACACAACTTGCA CGTCATCCTTTA TTGCTCGATGAA CTGCTCGACCCG CGCA-3' | glnE gene | | | |
| CI019 | ds70 | up | 323 | ACCGATCCGCAG GCGCGCATTTGTT ATGCCAATCCGG CATTCTGCCGCCA GACGGGTTTTGC ACTTGAGACACTT TTGGGCGAGAAC CACCGTCTGCTGG | 357 | AGTCTGAACTCA TCCTGCGGCAGT CGGTGAGACGTA TTTTTGACCAAAG AGTGATCTACAT CACGGAATTTTGT GGTTGTTGCTGCT TAAAAGGGCAAA T | 391 | 5'- ACCGATCCGCAG GCGCGCATTTGT TATGCCAATCCG GCATTCTGCCGC CAGACGGGTTTT GCACTTGAGACA CTTTTGGGCGAG AACCACCGTCTG CTGG/ AGTCTGAACTCA TCCTGCGGCAGT CGGTGAGACGTA TTTTTGACCAAA GAGTGATCTACA TCACGGAATTTT GTGGTTGTTGCT GCTTAAAAGGGC AAAT-3' | disrupted nifL gene/ Prm4 | N/A | N/A | N/A |
| CI019 | ds70 | down | 324 | CATCGGACACCA CCAGCTTACAAA TTGCCTGATTGCG GCCCCGATGGCC GGTATCACTGAC CGACCATTTCGTG CCTTATGTCATGC GATGGGGGCTGG G | 358 | CCGTCTCTGAAG CTCTCGGTGAAC ATTGTTGCGAGG CAGGATGCGAGC TGGTTGTGTTTTG ACATTACCGATA ATGTGCCGCGTG AACGGGTGCGTT ATG | 392 | 5'- CATCGGACACCA CCAGCTTACAAA TTGCCTGATTGC GGCCCCGATGGC CGGTATCACTGA CCGACCATTTCG TGCCTTATGTCA TGCGATGGGGGC TGGG/ CCGTCTCTGAAG CTCTCGGTGAAC ATTGTTGCGAGG CAGGATGCGAGC TGGTTGTGTTTT GACATTACCGAT AATGTGCCGCGT GAACGGGTGCGT TATG-3' | Prm4/ disrupted nifL gene | N/A | N/A | N/A |
| 137 | ds799 | down | 325 | TCTTCAACAACTG GAGGAATAAGT ATTAAAGGCGGA AAACGAGTTCAA ACGGCACGTCCG AATCGTATCAAT GGCGAGATTCGC GCCCTGGAAGTT CGC | 359 | GCCATTGAGCTG GCTTCCCGACCG CAGGGCGGCACC TGCCTGACCCTGC GTTTCCCGCTGTT TAACACCCTGAC CGGAGGTGAAGC ATGATCCCTGAA TC | 393 | 5'- TCTTCAACAACT GGAGGAATAAGG TATTAAAGGCGG AAAACGAGTTCA AACGGCACGTCC GAATCGTATCAA TGGCGAGATTCG CGCCCTGGAAGT TCGC/ GCCATTGAGCTG GCTTCCCGACCG CAGGGCGGCACC TGCCTGACCCTG CGTTTCCCGCTG | PinfC/ disrupted nifL gene | SEQ ID NO: 417 CTCG GCAG CATG GACG TAA | SEQ ID NO: 418 AGGG TGTT AAAC AGCG GGAA A | SEQ ID NO: 419/ 56- FAM/ AA CGG CAC G/ ZEN/ TCCG AAT CGT ATC |

TABLE 30-continued

Microbial Detection

| base CI | Junction Name | up/down stream junction | SEQ ID NO | 100 bp upstream of junction | SEQ ID NO | 100 bp downstream of junction | SEQ ID NO | Junction "/" indicating junction | Junction des. | F primer SEQ | R primer SEQ | Probe SEQ |
|---|---|---|---|---|---|---|---|---|---|---|---|---|
| | | | | | | | | TTTAACACCCTG ACCGGAGGTGAA GCATGATCCCTG AATC-3' | | | | AA/ 3IAB kFQ/ |
| 137 | ds799 | up | 326 | TCCGGGTTCGGCT TACCCCGCCGCGT TTTGCGCACGGTG TCGGACAATTTGT CATAACTGCGAC ACAGGAGTTTGC GATGACCCTGAA TATGATGCTCGA | 360 | AGCGTCAGGTAC CGGTCATGATTC ACCGTGCGATTCT CGGTTCCCTGGA GCGCTTCATTGGC ATCCTGACCGAA GAGTTCGCTGGC TTCTTCCCAACCT G | 394 | 5'- TCCGGGTTCGGC TTACCCCGCCGC GTTTTGCGCACG GTGTCGGACAAT TTGTCATAACTG CGACACAGGAGT TTGCGATGACCC TGAATATGATGC TCGA/ AGCGTCAGGTAC CGGTCATGATTC ACCGTGCGATTC TCGGTTCCCTGG AGCGCTTCATTG GCATCCTGACCG AAGAGTTCGCTG GCTTCTTCCCAA CCTG-3' | disrupted nifL gene/ PinfC | N/A | N/A | N/A |
| 137 | ds809 | N/A | 327 | ATCGCAGCGTCTT TGAATATTTCCGT CGCCAGGCGCTG GCTGCCGAGCCG TTCTGGCTGCATA GTGGAAAACGAT AATTTCAGGCCA GGGAGCCCTTAT G | 361 | GCGCTGAAGCAC CTGATCACGCTCT GCGCGGCGTCGC CGATGGTCGCCA GCCAGCTGGCGC GCCACCCGCTGC TGCTGGATGAGC TGCTGGATCCCA ACA | 395 | 5'- ATCGCAGCGTCT TTGAATATTTCC GTCGCCAGGCGC TGGCTGCCGAGC CGTTCTGGCTGC ATAGTGGAAAAC GATAATTTCAGG CCAGGGAGCCCT TATG/ GCGCTGAAGCAC CTGATCACGCTC TGCGCGGCGTCG CCGATGGTCGCC AGCCAGCTGGCG CGCCACCCGCTG CTGCTGGATGAG CTGCTGGATCCC AACA-3' | 5' UTR and ATG/ truncated glnE gene | SEQ ID NO: 420 GAGC CGTT CTGG CTGC ATAG | SEQ ID NO: 421 GCCG TCGG CTGA TAGA GG | SEQ ID NO: 422/ 56-FAM/ TTAT GGC GC/ ZEN/ TGAA GCA CCTG ATC A/ 3IAB kFQ/ |
| 137 | ds843 | up | 328 | TCCGGGTTCGGCT TACCCCGCCGCGT TTTGCGCACGGTG TCGGACAATTTGT CATAACTGCGAC ACAGGAGTTTGC GATGACCCTGAA TATGATGCTCGA | 362 | GCCCGCTGACCG ACCAGAACTTCC ACCTTGGACTCG GCTATACCCTTGG CGTGACGGCGCG CGATAACTGGGA CTACATCCCCATT CCGGTGATCTTAC C | 396 | 5'- TCCGGGTTCGGC TTACCCCGCCGC GTTTTGCGCACG GTGTCGGACAAT TTGTCATAACTG CGACACAGGAGT TTGCGATGACCC TGAATATGATGC TCGA/ GCCCGCTGACCG ACCAGAACTTCC ACCTTGGACTCG GCTATACCCTTG GCGTGACGGCGC GCGATAACTGGG ACTACATCCCCA TTCCGGTGATCT TACC-3' | disrupted nifL gene/ Prm1.2 | N/A | N/A | N/A |
| 137 | ds843 | down | 329 | TCACTTTTTAGCA AAGTTGCACTGG ACAAAAGGTACC ACAATTGGTGTA CTGATACTCGAC ACAGCATTAGTG TCGATTTTTCATA | 363 | GCCATTGAGCTG GCTTCCCGACCG CAGGGCGGCACC TGCCTGACCCTGC GTTTCCCGCTGTT TAACACCCTGAC CGGAGGTGAAGC | 397 | 5'- TCACTTTTTAGC AAAGTTGCACTG GACAAAAGGTAC CACAATTGGTGT ACTGATACTCGA CACAGCATTAGT | Prm1.2/ disrupted nifL gene | N/A | N/A | N/A |

TABLE 30-continued

Microbial Detection

| base CI | Junction Name | up/down stream junction | SEQ ID NO | 100 bp upstream of junction | SEQ ID NO | 100 bp downstream of junction | SEQ ID NO | Junction "/" indicating junction | Junction des. | F primer SEQ | R primer SEQ | Probe SEQ |
|---|---|---|---|---|---|---|---|---|---|---|---|---|
| | | | | TAAAGGTAATTTT G | | ATGATCCCTGAA TC | | GTCGATTTTTCA TATAAAGGTAAT TTTG/ GCCATTGAGCTG GCTTCCCGACCG CAGGGCGGCACC TGCCTGACCCTG CGTTTCCCGCTG TTTAACACCCTG ACCGGAGGTGAA GCATGATCCCTG AATC-3' | | | | |
| 137 | ds853 | up | 330 | TCCGGGTTCGGCT TACCCCGCCGCGT TTTGCGCACGGTG TCGGACAATTTGT CATAACTGCGAC ACAGGAGTTTGC GATGACCCTGAA TATGATGCTCGA | 364 | GCTAAAGTTCTC GGCTAATCGCTG ATAACATTTGAC GCAATGCGCAAT AAAAGGGCATCA TTTGATGCCCTTT TTGCACGCTTTCA TACCAGAACCTG GC | 398 | 5'- TCCGGGTTCGGC TTACCCCGCCGC GTTTTGCGCACG GTGTCGGACAAT TTGTCATAACTG CGACACAGGAGT TTGCGATGACCC TGAATATGATGC TCGA/ GCTAAAGTTCTC GGCTAATCGCTG ATAACATTTGAC GCAATGCGCAAT AAAAGGGCATCA TTTGATGCCCTT TTTGCACGCTTT CATACCAGAACC TGGC-3' | disrupted nifL gene/Prm6.2 | N/A | N/A | N/A |
| 137 | ds853 | down | 331 | GTTCTCCTTTGCA ATAGCAGGGAAG AGGCGCCAGAAC CGCCAGCGTTGA AGCAGTTTGAAC GCGTTCAGTGTAT AATCCGAAACTT AATTTCGGTTTGG A | 365 | GCCATTGAGCTG GCTTCCCGACCG CAGGGCGGCACC TGCCTGACCCTGC GTTTCCCGCTGTT TAACACCCTGAC CGGAGGTGAAGC ATGATCCCTGAA TC | 399 | 5'- GTTCTCCTTTGC AATAGCAGGGAA GAGGCGCCAGAA CCGCCAGCGTTG AAGCAGTTTGAA CGCGTTCAGTGT ATAATCCGAAAC TTAATTTCGGTT TGGA/ GCCATTGAGCTG GCTTCCCGACCG CAGGGCGGCACC TGCCTGACCCTG CGTTTCCCGCTG TTTAACACCCTG ACCGGAGGTGAA GCATGATCCCTG AATC-3' | Prm6.2/ disrupted nifL gene | N/A | N/A | N/A |
| 137 | ds857 | up | 332 | TCCGGGTTCGGCT TACCCCGCCGCGT TTTGCGCACGGTG TCGGACAATTTGT CATAACTGCGAC ACAGGAGTTTGC GATGACCCTGAA TATGATGCTCGA | 366 | CGCCGTCCTCGC AGTACCATTGCA ACCGACTTTACA GCAAGAAGTGAT TCTGGCACGCAT GGAACAAATTCT TGCCAGTCGGGC TTTATCCGATGAC GAA | 400 | 5'- TCCGGGTTCGGC TTACCCCGCCGC GTTTTGCGCACG GTGTCGGACAAT TTGTCATAACTG CGACACAGGAGT TTGCGATGACCC TGAATATGATGC TCGA/ CGCCGTCCTCGC AGTACCATTGCA ACCGACTTTACA GCAAGAAGTGAT TCTGGCACGCAT GGAACAAATTCT TGCCAGTCGGGC TTTATCCGATGA CGAA-3' | disrupted nifL gene/Prm8.2 | N/A | N/A | N/A |

TABLE 30-continued

Microbial Detection

| base CI | Junction Name | up/down stream junction | SEQ ID NO | 100 bp upstream of junction | SEQ ID NO | 100 bp downstream of junction | SEQ ID NO | Junction "/" indicating junction | Junction des. | F primer SEQ | R primer SEQ | Probe SEQ |
|---|---|---|---|---|---|---|---|---|---|---|---|---|
| 137 | ds857 | down | 333 | GATATGCCTGAA GTATTCAATTACT TAGGCATTTACTT AACGCAGGCAGG CAATTTTGATGCT GCCTATGAAGCG TTTGATTCTGTAC TTGAGCTTGATC | 367 | GCCATTGAGCTG GCTTCCCGACCG CAGGGCGGCACC TGCCTGACCCTGC GTTTCCCGCTGTT TAACACCCTGAC CGGAGGTGAAGC ATGATCCCTGAA TC | 401 | 5'-GATATGCCTGAA GTATTCAATTAC TTAGGCATTTAC TTAACGCAGGCA GGCAATTTTGAT GCTGCCTATGAA GCGTTTGATTCT GTACTTGAGCTT GATC/ GCCATTGAGCTG GCTTCCCGACCG CAGGGCGGCACC TGCCTGACCCTG CGTTTCCCGCTG TTTAACACCCTG ACCGGAGGTGAA GCATGATCCCTG AATC-3' | Prm8.2/disrupted nifL gene | N/A | N/A | N/A |
| 63 | ds908 | down | 334 | TGGTATTGTCAGT CTGAATGAAGCT CTTGAAAAAGCT GAGGAAGCGGGC GTCGATTTAGTAG AAATCAGTCCGA ATGCCGAGCCGC CAGTTTGTCGAAT C | 368 | TCTTTAGATCTCT CGGTCCGCCCTG ATGGCGGCACCT TGCTGACGTTAC GCCTGCCGGTAC AGCAGGTTATCA CCGGAGGCTTAA AATGACCCAGTT ACC | 402 | 5'-TGGTATTGTCAG TCTGAATGAAGC TCTTGAAAAAGC TGAGGAAGCGGG CGTCGATTTAGT AGAAATCAGTCC GAATGCCGAGCC GCCAGTTTGTCG AATC/ TCTTTAGATCTC TCGGTCCGCCCT GATGGCGGCACC TTGCTGACGTTA CGCCTGCCGGTA CAGCAGGTTATC ACCGGAGGCTTA AAATGACCCAGT TACC-3' | PinfC/disrupted nifL gene | SEQ ID NO: 423 GGAA AACG AGTT CAAC CGGC | SEQ ID NO: 424 GGGC GGAC CGAG AGAT CTAA | N/A |
| 63 | ds908 | up | 335 | TGCAAATTGCAC GGTTATTCCGGGT GAGTATATGTGT GATTTGGGTTCCG GCATTGCGCAAT AAAGGGGAGAAA GACATGAGCATC ACGGCGTTATCA GC | 369 | TGAATATCACTG ACTCACAAGCTA CCTATGTCGAAG AATTAACTAAAA AACTGCAAGATG CAGGCATTCGCG TTAAAGCCGACT TGAGAAATGAGA AGAT | 403 | 5'-TGCAAATTGCAC GGTTATTCCGGG TGAGTATATGTG TGATTTGGGTTC CGGCATTGCGCA ATAAAGGGGAGA AAGACATGAGCA TCACGGCGTTAT CAGC/ TGAATATCACTG ACTCACAAGCTA CCTATGTCGAAG AATTAACTAAAA AACTGCAAGATG CAGGCATTCGCG TTAAAGCCGACT TGAGAAATGAGA AGAT-3' | disrupted nifL gene/PinfC | N/A | N/A | N/A |
| 910 | ds960 | up | 336 | TCAGGGCTGCGG ATGTCGGGCGTTT CACAACACAAAA TGTTGTAAATGCG ACACAGCCGGGC CTGAAACCAGGA GCGTGTGATGAC CTTTAATATGATG C | 370 | CTGGGGTCACTG GAGCGCTTTATC GGCATCCTGACC GAAGAATTTGCC GGTTTCTTCCCGA CCTGGCTGGCCC CTGTTCAGGTTGT GGTGATGAATAT CA | 404 | 5'-TCAGGGCTGCGG ATGTCGGGCGTT TCACAACACAAA ATGTTGTAAATG CGACACAGCCGG GCCTGAAACCAG GAGCGTGTGATG ACCTTTAATATG ATGC/ CTGGGGTCACTG | disrupted nifL gene/PinfC | N/A | N/A | N/A |

TABLE 30-continued

| | | | | | | | | | | | | |
|---|---|---|---|---|---|---|---|---|---|---|---|---|
| | | | | | | | Microbial Detection | | | | | |

| base CI | Junc-tion Name | up/down stream junc-tion | SEQ ID NO | 100 bp upstream of junction | SEQ ID NO | 100 bp downstream of junction | SEQ ID NO | Junction "/" indicating junction | Junction des. | F primer SEQ | R primer SEQ | Probe SEQ |
|---|---|---|---|---|---|---|---|---|---|---|---|---|
| | | | | | | | | GAGCGCTTTATC GGCATCCTGACC GAAGAATTTGCC GGTTTCTTCCCG ACCTGGCTGGCC CCTGTTCAGGTT GTGGTGATGAAT ATCA-3' | | | | |
| 910 | ds960 | down | 337 | CGGAAAACGAGT TCAAACGGCACG TCCGAATCGTATC AATGGCGAGATT CGCGCCCAGGAA GTTCGCTTAACTG GTCTGGAAGGTG AGCAGCTGGGTA TT | 371 | GCAATAGAACTA ACTACCCGCCCT GAAGGCGGTACC TGCCTGACCCTGC GATTCCCGTTATT TCATTCACTGACC GGAGGCCCACGA TGACCCAGCGAC C | 405 | 5'- CGGAAAACGAGT TCAAACGGCACG TCCGAATCGTAT CAATGGCGAGAT TCGCGCCCAGGA AGTTCGCTTAAC TGGTCTGGAAGG TGAGCAGCTGGG TATT/ GCAATAGAACTA ACTACCCGCCCT GAAGGCGGTACC TGCCTGACCCTG CGATTCCCGTTA TTTCATTCACTG ACCGGAGGCCCA CGATGACCCAGC GACC-3' | PinfC/ disrupted nifL gene | N/A | N/A | N/A |
| 137 | ds2551 | up | 425 | CTTCGGCGGCGT GAAGAAGAGTGG TTTTGGTCGCGAG CTGTCACATTTTG GTCTGCACGAGTT CTGTAATGCGCA GACCGTCTGGAA AGACCGTCGCTA A | 427 | GCCCGCTGACCG ACCAGAACTTCC ACCTTGGACTCG GCTATACCCTTGG CGTGACGGCGCG CGATAACTGGGA CTACATCCCCATT CCGGTGATCTTAC C | 429 | 5'- CTTCGGCGGCGT GAAGAAGAGTGG TTTTGGTCGCGA GCTGTCACATTT TGGTCTGCACGA GTTCTGTAATGC GCAGACCGTCTG GAAAGACCGTCG CTAA/ GCCCGCTGACCG ACCAGAACTTCC ACCTTGGACTCG GCTATACCCTTG GCGTGACGGCGC GCGATAACTGGG ACTACATCCCCA TTCCGGTGATCT TACC-3' | 3' end of sad (Succinate semialdehyde dehydro-genase)/ Prm1.2 | N/A | N/A | N/A |
| 137 | ds2551 | down | 426 | TCACTTTTTAGCA AAGTTGCACTGG ACAAAAGGTACC ACAATTGGTGTA CTGATACTCGAC ACAGCATTAGTG TCGATTTTTCATA TAAAGGTAATTTT G | 428 | ATGGCGGCGGTG ATCAATAACGCA ATGCTGGAAGCC ATTCTGGCAGAA ATCAGGCCGCTG ATTGGCCGCGGT AAAGTGGCGGAT TACATTCCGGCG CTGG | 430 | 5'- TCACTTTTTAGC AAAGTTGCACTG GACAAAAGGTAC CACAATTGGTGT ACTGATACTCGA CACAGCATTAGT GTCGATTTTTCA TATAAAGGTAAT TTTG/ ATGGCGGCGGTG ATCAATAACGCA ATGCTGGAAGCC ATTCTGGCAGAA ATCAGGCCGCTG ATTGGCCGCGGT AAAGTGGCGGAT TACATTCCGGCG CTGG-3' | Prm1.2/ glsA2 | N/A | N/A | N/A |

TABLE 31

| | Remodeled Non-intergeneric Microbes | |
| --- | --- | --- |
| Strain Name | Genotype | SEQ ID NO |
| CI006 | 16S rDNA-contig 5 | 62 |
| CI006 | 16S rDNA-contig 8 | 63 |
| CI019 | 16S rDNA | 64 |
| CI006 | nifH | 65 |
| CI006 | nifD | 66 |
| CI006 | nifK | 67 |
| CI006 | nifL | 68 |
| CI006 | nifA | 69 |
| CI019 | nifH | 70 |
| CI019 | nifD | 71 |
| CI019 | nifK | 72 |
| CI019 | nifL | 73 |
| CI019 | nifA | 74 |
| CI006 | Prm5 with 500bp flanking regions | 75 |

TABLE 31-continued

| | Remodeled Non-intergeneric Microbes | |
| --- | --- | --- |
| Strain Name | Genotype | SEQ ID NO |
| CI006 | nifLA operon-upstream intergenic region plus nifL and nifA CDSs | 76 |
| CI006 | nifL (Amino Acid) | 77 |
| CI006 | nifA (Amino Acid) | 78 |
| CI006 | glnE | 79 |
| CI006 | glnE_KO1 | 80 |
| CI006 | glnE (Amino Acid) | 81 |
| CI006 | glnE_KO1 (Amino Acid) | 82 |
| CI006 | GlnE ATase domain (Amino Acid) | 83 |
| CM029 | Prm5 inserted into nifL region | 84 |

TABLE 32

| | | | Remodeled Non-intergeneric Microbes | | |
| --- | --- | --- | --- | --- | --- |
| Strain | Strain ID | SEQ ID NO | Genotype | Description | Associated Novel Junction If Applicable |
| CI63; CI063 | 63 | SEQ ID NO 85 | 16S | N/A | N/A |
| CI63; CI063 | 63 | SEQ ID NO 86 | nifH | N/A | N/A |
| CI63; CI063 | 63 | SEQ ID NO 87 | nifD1 | 1 of 2 unique genes annotated as nifD in 63 genome | N/A |
| CI63; CI063 | 63 | SEQ ID NO 88 | nifD2 | 2 of 2 unique genes annotated as nifD in 63 genome | N/A |
| CI63; CI063 | 63 | SEQ ID NO 89 | nifK1 | 1 of 2 unique genes annotated as nifK in 63 genome | N/A |
| CI63; CI063 | 63 | SEQ ID NO 90 | nifK2 | 2 of 2 unique genes annotated as nifK in 63 genome | N/A |
| CI63; CI063 | 63 | SEQ ID NO 91 | nifL | N/A | N/A |
| CI63; CI063 | 63 | SEQ ID NO 92 | nifA | N/A | N/A |
| CI63; CI063 | 63 | SEQ ID NO 93 | glnE | N/A | N/A |
| CI63; CI063 | 63 | SEQ ID NO 94 | amtB | N/A | N/A |
| CI63; CI063 | 63 | SEQ ID NO 95 | PinfC | 500bp immediately upstream of the ATG start codon of the infC gene | N/A |
| CI137 | 137 | SEQ ID NO 96 | 16S | N/A | N/A |
| CI137 | 137 | SEQ ID NO 97 | nifH1 | 1 of 2 unique genes annotated as nifH in 137 genome | N/A |
| CI137 | 137 | SEQ ID NO 98 | nifH2 | 2 of 2 unique genes annotated as nifH in 137 genome | N/A |
| CI137 | 137 | SEQ ID NO 99 | nifD1 | 1 of 2 unique genes annotated as nifD in 137 genome | N/A |
| CI137 | 137 | SEQ ID NO 100 | nifD2 | 2 of 2 unique genes annotated as nifD in 137 genome | N/A |
| CI137 | 137 | SEQ ID NO 101 | nifK1 | 1 of 2 unique genes annotated as nifK in 137 genome | N/A |
| CI137 | 137 | SEQ ID NO 102 | nifK2 | 2 of 2 unique genes annotated as nifK in 137 genome | N/A |
| CI137 | 137 | SEQ ID NO 103 | nifL | N/A | N/A |
| CI137 | 137 | SEQ ID NO 104 | nifA | N/A | N/A |
| CI137 | 137 | SEQ ID NO 105 | glnE | N/A | N/A |
| CI137 | 137 | SEQ ID NO 106 | PinfC | 500bp immediately upstream of the TTG start codon of infC | N/A |
| CI137 | 137 | SEQ ID NO 107 | amtB | N/A | N/A |
| CI137 | 137 | SEQ ID NO 108 | Prm8.2 | internal promoter located in nlpI gene; 299bp starting at 81bp after the A of the ATG of the nlpI gene | N/A |

TABLE 32-continued

Remodeled Non-intergeneric Microbes

| Strain | Strain ID | SEQ ID NO | Genotype | Description | Associated Novel Junction If Applicable |
|---|---|---|---|---|---|
| CI137 | 137 | SEQ ID NO 109 | Prm6.2 | 300bp upstream of the secE gene starting at 57bp upstream of the A of the ATG of secE | N/A |
| CI137 | 137 | SEQ ID NO 110 | Prm1.2 | 400bp immediately upstream of the ATG of cspE gene | N/A |
| none | 728 | SEQ ID NO 111 | 16S | N/A | N/A |
| none | 728 | SEQ ID NO 112 | nifH | N/A | N/A |
| none | 728 | SEQ ID NO 113 | nifD1 | 1 of 2 unique genes annotated as nifD in 728 genome | N/A |
| none | 728 | SEQ ID NO 114 | nifD2 | 2 of 2 unique genes annotated as nifD in 728 genome | N/A |
| none | 728 | SEQ ID NO 115 | nifK1 | 1 of 2 unique genes annotated as nifK in 728 genome | N/A |
| none | 728 | SEQ ID NO 116 | nifK2 | 2 of 2 unique genes annotated as nifK in 728 genome | N/A |
| none | 728 | SEQ ID NO 117 | nifL | N/A | N/A |
| none | 728 | SEQ ID NO 118 | nifA | N/A | N/A |
| none | 728 | SEQ ID NO 119 | glnE | N/A | N/A |
| none | 728 | SEQ ID NO 120 | amtB | N/A | N/A |
| none | 850 | SEQ ID NO 121 | 16S | N/A | N/A |
| none | 852 | SEQ ID NO 122 | 16S | N/A | N/A |
| none | 853 | SEQ ID NO 123 | 16S | N/A | N/A |
| none | 910 | SEQ ID NO 124 | 16S | N/A | N/A |
| none | 910 | SEQ ID NO 125 | nifH | N/A | N/A |
| none | 910 | SEQ ID NO 126 | Dinitrogenase iron-molybdenum cofactor CDS | N/A | N/A |
| none | 910 | SEQ ID NO 127 | nifD1 | N/A | N/A |
| none | 910 | SEQ ID NO 128 | nifD2 | N/A | N/A |
| none | 910 | SEQ ID NO 129 | nifK1 | N/A | N/A |
| none | 910 | SEQ ID NO 130 | nifK2 | N/A | N/A |
| none | 910 | SEQ ID NO 131 | nifL | N/A | N/A |
| none | 910 | SEQ ID NO 132 | nifA | N/A | N/A |
| none | 910 | SEQ ID NO 133 | glnE | N/A | N/A |
| none | 910 | SEQ ID NO 134 | amtB | N/A | N/A |
| none | 910 | SEQ ID NO 135 | PinfC | 498bp immediately upstream of the ATG of the infC gene | N/A |
| none | 1021 | SEQ ID NO 136 | 16S | N/A | N/A |
| none | 1021 | SEQ ID NO 137 | nifH | N/A | N/A |
| none | 1021 | SEQ ID NO 138 | nifD1 | 1 of 2 unique genes annotated as nifD in 910 genome | N/A |
| none | 1021 | SEQ ID NO 139 | nifD2 | 2 of 2 unique genes annotated as nifD in 910 genome | N/A |
| none | 1021 | SEQ ID NO 140 | nifK1 | 1 of 2 unique genes annotated as nifK in 910 genome | N/A |
| none | 1021 | SEQ ID NO 141 | nifK2 | 2 of 2 unique genes annotated as nifK in 910 genome | N/A |
| none | 1021 | SEQ ID NO 142 | nifL | N/A | N/A |
| none | 1021 | SEQ ID NO 143 | nifA | N/A | N/A |

TABLE 32-continued

Remodeled Non-intergeneric Microbes

| Strain | Strain ID | SEQ ID NO | Genotype | Description | Associated Novel Junction If Applicable |
|--------|-----------|-----------|----------|-------------|------------------------------------------|
| none | 1021 | SEQ ID NO 144 | glnE | N/A | N/A |
| none | 1021 | SEQ ID NO 145 | amtB | N/A | N/A |
| none | 1021 | SEQ ID NO 146 | PinfC | 500bp immediately upstream of the ATG start codon of the infC gene | N/A |
| none | 1021 | SEQ ID NO 147 | Prm1 | 348bp includes the 319bp immediately upstream of the ATG start codon of the lpp gene and the first 29bp of the lpp gene | N/A |
| none | 1021 | SEQ ID NO 148 | Prm7 | 339bp upstream of the sspA gene, ending at 46bp upstream of the ATG of the sspA gene | N/A |
| none | 1113 | SEQ ID NO 149 | 16S | N/A | N/A |
| none | 1113 | SEQ ID NO 150 | nifH | N/A | N/A |
| none | 1113 | SEQ ID NO 151 | nifD1 | 1 of 2 unique genes annotated as nifD in 1113 genome | N/A |
| none | 1113 | SEQ ID NO 152 | nifD2 | 2 of 2 unique genes annotated as nifD in 1113 genome | N/A |
| none | 1113 | SEQ ID NO 153 | nifK | N/A | N/A |
| none | 1113 | SEQ ID NO 154 | nifL | N/A | N/A |
| none | 1113 | SEQ ID NO 155 | nifA partial gene | due to a gap in the sequence assembly, we can only identify a partial gene from the 1113 genome | N/A |
| none | 1113 | SEQ ID NO 156 | glnE | N/A | N/A |
| none | 1116 | SEQ ID NO 157 | 16S | | N/A |
| none | 1116 | SEQ ID NO 158 | nifH | | N/A |
| none | 1116 | SEQ ID NO 159 | nifD1 | 1 of 2 unique genes annotated as nifD in 1116 genome | N/A |
| none | 1116 | SEQ ID NO 160 | nifD2 | 2 of 2 unique genes annotated as nifD in 1116 genome | N/A |
| none | 1116 | SEQ ID NO 161 | nifK1 | 1 of 2 unique genes annotated as nifK in 1116 genome | N/A |
| none | 1116 | SEQ ID NO 162 | nifK2 | 2 of 2 unique genes annotated as nifK in 1116 genome | N/A |
| none | 1116 | SEQ ID NO 163 | nifL | N/A | N/A |
| none | 1116 | SEQ ID NO 164 | nifA | N/A | N/A |
| none | 1116 | SEQ ID NO 165 | glnE | N/A | N/A |
| none | 1116 | SEQ ID NO 166 | amtB | N/A | N/A |
| none | 1293 | SEQ ID NO 167 | 16S | N/A | N/A |
| none | 1293 | SEQ ID NO 168 | nifH | N/A | N/A |
| none | 1293 | SEQ ID NO 169 | nifD1 | 1 of 2 unique genes annotated as nifD in 1293 genome | N/A |
| none | 1293 | SEQ ID NO 170 | nifD2 | 2 of 2 unique genes annotated as nifD in 1293 genome | N/A |
| none | 1293 | SEQ ID NO 171 | nifK | 1 of 2 unique genes annotated as nifK in 1293 genome | N/A |
| none | 1293 | SEQ ID NO 172 | nifK1 | 2 of 2 unique genes annotated as nifK in 1293 genome | N/A |
| none | 1293 | SEQ ID NO 173 | nifA | N/A | N/A |
| none | 1293 | SEQ ID NO 174 | glnE | N/A | N/A |
| none | 1293 | SEQ ID NO 175 | amtB1 | 1 of 2 unique genes annotated as amtB in 1293 genome | N/A |
| none | 1293 | SEQ ID NO 176 | amtB2 | 2 of 2 unique genes annotated as amtB in 1293 genome | N/A |

TABLE 32-continued

Remodeled Non-intergeneric Microbes

| Strain | Strain ID | SEQ ID NO | Genotype | Description | Associated Novel Junction If Applicable |
|---|---|---|---|---|---|
| none | 1021-1612 | SEQ ID NO 177 | ΔnifL::PinfC | starting at 24bp after the A of the ATG start codon, 1375bp of nifL have been deleted and replaced with the 1021 PinfC promoter sequence | ds1131 |
| none | 1021-1612 | SEQ ID NO 178 | ΔnifL::PinfC with 500bp flank | starting at 24bp after the A of the ATG start codon, 1375bp of nifL have been deleted and replaced with the 1021 PinfC promoter sequence; 500bp flanking the nifL gene upstream and downstream are included | ds1131 |
| none | 1021-1612 | SEQ ID NO 179 | glnEΔAR-2 | glnE gene with 1673bp immediately downstream of the ATG start codon deleted, resulting in a truncated glnE protein lacking the adenylyl-removing (AR) domain | ds1133 |
| none | 1021-1612 | SEQ ID NO 180 | glnEΔAR-2 with 500bp flank | glnE gene with 1673bp immediately downstream of the ATG start codon deleted, resulting in a truncated glnE protein lacking the adenylyl-removing (AR) domain; 500bp flanking the glnE gene upstream and downstream are included | ds1133 |
| none | 1021-1615 | SEQ ID NO 181 | ΔnifL::Prm1 | starting at 24bp after the A of the ATG start codon, 1375bp of nifL have been deleted and replaced with the 1021 Prm1 promoter sequence | ds1145 |
| none | 1021-1615 | SEQ ID NO 182 | ΔnifL::Prm1 with 500bp flank | starting at 24bp after the A of the ATG start codon, 1375bp of nifL have been deleted and replaced with the 1021 rm1 promoter sequence; 500bp flanking the nifL gene upstream and downstream are included | ds1145 |
| none | 1021-1615 | SEQ ID NO 183 | glnEΔAR-2 | glnE gene with 1673bp immediately downstream of the ATG start codon deleted, resulting in a truncated glnE protein lacking the adenylyl-removing (AR) domain | ds1133 |
| none | 1021-1615 | SEQ ID NO 184 | glnEΔAR-2 with 500bp flank | glnE gene with 1673bp immediately downstream of the ATG start codon deleted, resulting in a truncated glnE protein lacking the adenylyl-removing (AR) domain; 500bp flanking the glnE gene upstream and downstream are included | ds1133 |
| none | 1021-1619 | SEQ ID NO 185 | ΔnifL::Prm1 | starting at 24bp after the A of the ATG start codon, 1375bp of nifL have been deleted and replaced with the 1021 Prm1 promoter sequence | ds1145 |
| none | 1021-1619 | SEQ ID NO 186 | ΔnifL::Prm1 with 500bp flank | starting at 24bp after the A of the ATG start codon, 1375bp of nifL have been deleted and replaced with the 1021 rm1 promoter sequence; 500bp flanking the nifL gene upstream and downstream are included | ds1145 |
| none | 1021-1623 | SEQ ID NO 187 | glnEΔAR-2 | glnE gene with 1673bp immediately downstream of the ATG start codon deleted, resulting in a truncated glnE protein lacking the adenylyl-removing (AR) domain | ds1133 |
| none | 1021-1623 | SEQ ID NO 188 | glnEΔAR-2 with 500bp flank | glnE gene with 1673bp immediately downstream of the ATG start codon deleted, resulting in a truncated glnE protein lacking the adenylyl-removing (AR) domain; 500bp flanking the glnE gene upstream and downstream are included | ds1133 |
| none | 1021-1623 | SEQ ID NO 189 | ΔnifL::Prm7 | starting at 24bp after the A of the ATG start codon, 1375bp of nifL have been deleted and replaced with the 1021 Prm7 promoter sequence | ds1148 |

TABLE 32-continued

Remodeled Non-intergeneric Microbes

| Strain | Strain ID | SEQ ID NO | Genotype | Description | Associated Novel Junction If Applicable |
|---|---|---|---|---|---|
| none | 1021-1623 | SEQ ID NO 190 | ΔnifL::Prm7 with 500bp flank | starting at 24bp after the A of the ATG start codon, 1375bp of nifL have been deleted and replaced with the 1021 rm7 promoter sequence; 500bp flanking the nifL gene upstream and downstream are included | ds1148 |
| none | 137-1034 | SEQ ID NO 191 | glnEΔAR-2 | glnE gene with 1290bp immediately downstream of the ATG start codon deleted, resulting in a truncated glnE protein lacking the adenylyl-removing (AR) domain | ds809 |
| none | 137-1034 | SEQ ID NO 192 | glnEΔAR-2 with 500bp flank | glnE gene with 1290bp immediately downstream of the ATG start codon deleted, resulting in a truncated glnE protein lacking the adenylyl-removing (AR) domain; 500bp flanking the glnE gene upstream and downstream are included | ds809 |
| none | 137-1036 | SEQ ID NO 193 | ΔnifL::PinfC | starting at 24bp after the A of the ATG start codon, 1372bp of nifL have been deleted and replaced with the 137 PinfC promoter sequence | ds799 |
| none | 137-1036 | SEQ ID NO 194 | ΔnifL::PinfC with 500bp flank | starting at 24bp after the A of the ATG start codon, 1372bp of nifL have been deleted and replaced with the 137 PinfC promoter sequence; 500bp flanking the nifL gene upstream and downstream are included | ds799 |
| none | 137-1314 | SEQ ID NO 195 | glnEΔAR-2 36bp deletion | glnE gene with 1290bp immediately downstream of the ATG start codon deleted AND 36bp deleted beginning at 1472bp downstream of the start codon, resulting in a truncated glnE protein lacking the adenylyl-removing (AR) domain | none |
| none | 137-1314 | SEQ ID NO 196 | glnEΔAR-2 36bp deletion | glnE gene with 1290bp immediately downstream of the ATG start codon deleted AND 36bp deleted beginning at 1472bp downstream of the start codon, resulting in a truncated glnE protein lacking the adenylyl-removing (AR) domain; 500bp flanking the nifL gene upstream and downstream are included | none |
| none | 137-1314 | SEQ ID NO 197 | ΔnifL::Prm8.2 | starting at 24bp after the A of the ATG start codon, 1372bp of nifL have been deleted and replaced with the 137 Prm8.2 promoter sequence | ds857 |
| none | 137-1314 | SEQ ID NO 198 | ΔnifL::Prm8.2 with 500bp flank | starting at 24bp after the A of the ATG start codon, 1372bp of nifL have been deleted and replaced with the 137 Prm8.2 promoter sequence; 500bp flanking the nifL gene upstream and downstream are included | ds857 |
| none | 137-1329 | SEQ ID NO 199 | glnEΔAR-2 36bp deletion | glnE gene with 1290bp immediately downstream of the ATG start codon deleted AND 36bp deleted beginning at 1472bp downstream of the start codon, resulting in a truncated glnE protein lacking the adenylyl-removing (AR) domain | none |
| none | 137-1329 | SEQ ID NO 200 | glnEΔAR-2 36bp deletion | glnE gene with 1290bp immediately downstream of the ATG start codon deleted AND 36bp deleted beginning at 1472bp downstream of the start codon, resulting in a truncated glnE protein lacking the adenylyl-removing (AR) domain; 500bp flanking the nifL gene upstream and downstream are included | none |
| none | 137-1329 | SEQ ID NO 201 | ΔnifL::Prm6.2 | starting at 24bp after the A of the ATG start codon, 1372bp of nifL have been deleted and replaced with the 137 Prm6.2 promoter sequence | ds853 |

TABLE 32-continued

Remodeled Non-intergeneric Microbes

| Strain | Strain ID | SEQ ID NO | Genotype | Description | Associated Novel Junction If Applicable |
|---|---|---|---|---|---|
| none | 137-1329 | SEQ ID NO 202 | ΔnifL::Prm6.2 with 500bp flank | starting at 24bp after the A of the ATG start codon, 1372bp of nifL have been deleted and replaced with the 137 Prm6.2 promoter sequence; 500bp flanking the nifL gene upstream and downstream are included | ds853 |
| none | 137-1382 | SEQ ID NO 203 | ΔnifL::Prm1.2 | starting at 24bp after the A of the ATG start codon, 1372bp of nifL have been deleted and replaced with the 137 Prm1.2 promoter sequence | ds843 |
| none | 137-1382 | SEQ ID NO 204 | ΔnifL::Prm1.2 with 500bp flank | starting at 24bp after the A of the ATG start codon, 1372bp of nifL have been deleted and replaced with the 137 Prm1.2 promoter sequence; 500bp flanking the nifL gene upstream and downstream are included | ds843 |
| none | 137-1382 | SEQ ID NO 205 | glnEΔAR-2 36bp deletion | glnE gene with 1290bp immediately downstream of the ATG start codon deleted AND 36bp deleted beginning at 1472bp downstream of the start codon, resulting in a truncated glnE protein lacking the adenylyl-removing (AR) domain | none |
| none | 137-1382 | SEQ ID NO 206 | glnEΔAR-2 36bp deletion | glnE gene with 1290bp immediately downstream of the ATG start codon deleted AND 36bp deleted beginning at 1472bp downstream of the start codon, resulting in a truncated glnE protein lacking the adenylyl-removing (AR) domain; 500bp flanking the nifL gene upstream and downstream are included | none |
| none | 137-1586 | SEQ ID NO 207 | ΔnifL::PinfC | starting at 24bp after the A of the ATG start codon, 1372bp of nifL have been deleted and replaced with the 137 PinfC promoter sequence | ds799 |
| none | 137-1586 | SEQ ID NO 208 | ΔnifL::PinfC with 500bp flank | starting at 24bp after the A of the ATG start codon, 1372bp of nifL have been deleted and replaced with the 137 PinfC promoter sequence; 500bp flanking the nifL gene upstream and downstream are included | ds799 |
| none | 137-1586 | SEQ ID NO 209 | glnEΔAR-2 | glnE gene with 1290bp immediately downstream of the ATG start codon deleted, resulting in a truncated glnE protein lacking the adenylyl-removing (AR) domain | ds809 |
| none | 137-1586 | SEQ ID NO 210 | glnEΔAR-2 with 500bp flank | glnE gene with 1290bp immediately downstream of the ATG start codon deleted, resulting in a truncated glnE protein lacking the adenylyl-removing (AR) domain; 500bp flanking the glnE gene upstream and downstream are included | ds809 |
| none | 19-594 | SEQ ID NO 211 | glnEΔAR-2 | glnE gene with 1650bp immediately downstream of the ATG start codon deleted, resulting in a truncated glnE protein lacking the adenylyl-removing (AR) domain | ds34 |
| none | 19-594 | SEQ ID NO 212 | glnEΔAR-2 with 500bp flank | glnE gene with 1650bp immediately downstream of the ATG start codon deleted, resulting in a truncated glnE protein lacking the adenylyl-removing (AR) domain; 500bp flanking the glnE gene upstream and downstream are included | ds34 |
| none | 19-594 | SEQ ID NO 213 | ΔnifL::Prm6.1 | starting at 221bp after the A of the ATG start codon, 845bp of nifL have been deleted and replaced with the CI019 Prm6.1 promoter sequence | ds180 |
| none | 19-594 | SEQ ID NO 214 | ΔnifL::Prm6.1 with 500bp flank | starting at 221bp after the A of the ATG start codon, 845bp of nifL have been deleted and replaced with the CI019 Prm6.1promoter sequence; | ds180 |

Remodeled Non-intergeneric Microbes

| Strain | Strain ID | SEQ ID NO | Genotype | Description | Associated Novel Junction If Applicable |
|---|---|---|---|---|---|
| none | 19-714 | SEQ ID NO 215 | ΔnifL::Prm6.1 | 500bp flanking the nifL gene upstream and downstream are included starting at 221bp after the A of the ATG start codon, 845bp of nifL have been deleted and replaced with the CI019 Prm6.1 promoter sequence | ds180 |
| none | 19-714 | SEQ ID NO 216 | ΔnifL::Prm6.1 with 500bp flank | starting at 221bp after the A of the ATG start codon, 845bp of nifL have been deleted and replaced with the CI019 Prm6.1promoter sequence; 500bp flanking the nifL gene upstream and downstream are included | ds180 |
| none | 19-715 | SEQ ID NO 217 | ΔnifL::Prm7.1 | starting at 221bp after the A of the ATG start codon, 845bp of nifL have been deleted and replaced with the CI019 Prm7.1 promoter sequence | ds181 |
| none | 19-715 | SEQ ID NO 218 | ΔnifL::Prm7.1 with 500bp flank | starting at 221bp after the A of the ATG start codon, 845bp of nifL have been deleted and replaced with the CI019 Prm76.1promoter sequence; 500bp flanking the nifL gene upstream and downstream are included | ds181 |
| 19-713 | 19-750 | SEQ ID NO 219 | ΔnifL::Prm1.2 | starting at 221bp after the A of the ATG start codon, 845bp of nifL have been deleted and replaced with the CI019 Prm1.2 promoter sequence | ds172 |
| 19-713 | 19-750 | SEQ ID NO 220 | ΔnifL::Prm1.2 with 500bp flank | starting at 221bp after the A of the ATG start codon, 845bp of nifL have been deleted and replaced with the CI019 Prm1.2 promoter sequence; 500bp flanking the nifL gene upstream and downstream are included | ds172 |
| 17-724 | 19-804 | SEQ ID NO 221 | ΔnifL::Prm1.2 | starting at 221bp after the A of the ATG start codon, 845bp of nifL have been deleted and replaced with the CI019 Prm1.2 promoter sequence | ds172 |
| 17-724 | 19-804 | SEQ ID NO 222 | ΔnifL::Prm1.2 with 500bp flank | starting at 221bp after the A of the ATG start codon, 845bp of nifL have been deleted and replaced with the CI019 Prm1.2 promoter sequence; 500bp flanking the nifL gene upstream and downstream are included | ds172 |
| 17-724 | 19-804 | SEQ ID NO 223 | glnEΔAR-2 | glnE gene with 1650bp immediately downstream of the ATG start codon deleted, resulting in a truncated glnE protein lacking the adenylyl-removing (AR) domain | ds34 |
| 17-724 | 19-804 | SEQ ID NO 224 | glnEΔAR-2 with 500bp flank | glnE gene with 1650bp immediately downstream of the ATG start codon deleted, resulting in a truncated glnE protein lacking the adenylyl-removing (AR) domain; 500bp flanking the glnE gene upstream and downstream are included | ds34 |
| 19-590 | 19-806 | SEQ ID NO 225 | ΔnifL::Prm3.1 | starting at 221bp after the A of the ATG start codon, 845bp of nifL have been deleted and replaced with the CI019 Prm3.1 promoter sequence | ds175 |
| 19-590 | 19-806 | SEQ ID NO 226 | ΔnifL::Prm3.1 with 500bp flank | starting at 221bp after the A of the ATG start codon, 845bp of nifL have been deleted and replaced with the CI019 Prm3.1 promoter sequence; 500bp flanking the nifL gene upstream and downstream are included | ds175 |
| 19-590 | 19-806 | SEQ ID NO 227 | glnEΔAR-2 | glnE gene with 1650bp immediately downstream of the ATG start codon deleted, resulting in a truncated glnE protein lacking the adenylyl-removing (AR) domain | ds34 |
| 19-590 | 19-806 | SEQ ID NO 228 | glnEΔAR-2 with 500bp flank | glnE gene with 1650bp immediately downstream of the ATG start codon deleted, resulting in a truncated glnE protein lacking the adenylyl-removing | ds34 |

TABLE 32-continued

Remodeled Non-intergeneric Microbes

| Strain | Strain ID | SEQ ID NO | Genotype | Description | Associated Novel Junction If Applicable |
|---|---|---|---|---|---|
| | | | | (AR) domain; 500bp flanking the glnE gene upstream and downstream are included | |
| none | 63-1146 | SEQ ID NO 229 | ΔnifL::PinfC | starting at 24bp after the A of the ATG start codon, 1375bp of nifL have been deleted and replaced with the 63 PinfC promoter sequence | ds908 |
| none | 63-1146 | SEQ ID NO 230 | ΔnifL::PinfC with 500bp flank | starting at 24bp after the A of the ATG start codon, 1375bp of nifL have been deleted and replaced with the 63 PinfC promoter sequence; 500bp flanking the nifL gene upstream and downstream are included | ds908 |
| CM015; PBC6.15 | 6-397 | SEQ ID NO 231 | ΔnifL::Prm5 | starting at 31bp after the A of the ATG start codon, 1375bp of nifL have been deleted and replaced with the CI006 Prm5 promoter sequence | ds24 |
| CM015; PBC6.15 | 6-397 | SEQ ID NO 232 | ΔnifL::Prm5 with 500bp flank | starting at 31bp after the A of the ATG start codon, 1375bp of nifL have been deleted and replaced with the CI006 Prm5 promoter sequence; 500bp flanking the nifL gene upstream and downstream are included | ds24 |
| CM014 | 6-400 | SEQ ID NO 233 | ΔnifL::Prm1 | starting at 31bp after the A of the ATG start codon, 1375bp of nifL have been deleted and replaced with the CI006 Prm1 promoter sequence | ds20 |
| CM014 | 6-400 | SEQ ID NO 234 | ΔnifL::Prm1 with 500bp flank | starting at 31bp after the A of the ATG start codon, 1375bp of nifL have been deleted and replaced with the CI006 Prm1 promoter sequence; 500bp flanking the nifL gene upstream and downstream are included | ds20 |
| CM037; PBC6.37 | 6-403 | SEQ ID NO 235 | ΔnifL::Prm1 | starting at 31bp after the A of the ATG start codon, 1375bp of nifL have been deleted and replaced with the CI006 Prm1 promoter sequence | ds20 |
| CM037; PBC6.38 | 6-403 | SEQ ID NO 236 | ΔnifL::Prm1 with 500bp flank | starting at 31bp after the A of the ATG start codon, 1375bp of nifL have been deleted and replaced with the CI006 Prm1 promoter sequence; 500bp flanking the nifL gene upstream and downstream are included | ds20 |
| CM037; PBC6.39 | 6-403 | SEQ ID NO 237 | glnEΔAR-2 | glnE gene with 1644bp immediately downstream of the ATG start codon deleted, resulting in a truncated glnE protein lacking the adenylyl-removing (AR) domain | ds31 |
| CM037; PBC6.40 | 6-403 | SEQ ID NO 238 | glnEΔAR-2 with 500bp flank | glnE gene with 1644bp immediately downstream of the ATG start codon deleted, resulting in a truncated glnE protein lacking the adenylyl-removing (AR) domain; 500bp flanking the glnE gene upstream and downstream are included | ds31 |
| CM038; PBC6.38 | 6-404 | SEQ ID NO 239 | glnEΔAR-1 | glnE gene with 1287bp immediately downstream of the ATG start codon deleted, resulting in a truncated glnE protein lacking the adenylyl-removing (AR) domain | ds30 |
| CM038; PBC6.38 | 6-404 | SEQ ID NO 240 | ΔnifL::Prm1 | starting at 31bp after the A of the ATG start codon, 1375bp of nifL have been deleted and replaced with the CI006 Prm1 promoter sequence | ds20 |
| CM038; PBC6.38 | 6-404 | SEQ ID NO 241 | ΔnifL::Prm1 with 500bp flank | starting at 31bp after the A of the ATG start codon, 1375bp of nifL have been deleted and replaced with the CI006 Prm1 promoter sequence; 500bp flanking the nifL gene upstream and downstream are included | ds20 |
| CM038; PBC6.38 | 6-404 | SEQ ID NO 242 | glnEΔAR-1 with 500bp flank | glnE gene with 1287bp immediately downstream of the ATG start codon deleted, resulting in a truncated glnE | ds30 |

TABLE 32-continued

Remodeled Non-intergeneric Microbes

| Strain | Strain ID | SEQ ID NO | Genotype | Description | Associated Novel Junction If Applicable |
|---|---|---|---|---|---|
| | | | | protein lacking the adenylyl-removing (AR) domain; 500bp flanking the glnE gene upstream and downstream are included | |
| CM029; PBC6.29 | 6-412 | SEQ ID NO 243 | glnEΔAR-1 | glnE gene with 1287bp immediately downstream of the ATG start codon deleted, resulting in a truncated glnE protein lacking the adenylyl-removing (AR) domain | ds30 |
| CM029; PBC6.29 | 6-412 | SEQ ID NO 244 | glnEΔAR-1 with 500bp flank | glnE gene with 1287bp immediately downstream of the ATG start codon deleted, resulting in a truncated glnE protein lacking the adenylyl-removing (AR) domain; 500bp flanking the glnE gene upstream and downstream are included | ds30 |
| CM029; PBC6.29 | 6-412 | SEQ ID NO 245 | ΔnifL::Prm5 | starting at 31bp after the A of the ATG start codon, 1375bp of nifL have been deleted and replaced with the CI006 Prm5 promoter sequence | ds24 |
| CM029; PBC6.29 | 6-412 | SEQ ID NO 246 | ΔnifL::Prm5 with 500bp flank | starting at 31bp after the A of the ATG start codon, 1375bp of nifL have been deleted and replaced with the CI006 Prm5 promoter sequence; 500bp flanking the nifL gene upstream and downstream are included | ds24 |
| CM093; PBC6.93 | 6-848 | SEQ ID NO 247 | ΔnifL::Prm1 | starting at 31bp after the A of the ATG start codon, 1375bp of nifL have been deleted and replaced with the CI006 Prm1 promoter sequence | ds20 |
| CM093; PBC6.93 | 6-848 | SEQ ID NO 248 | ΔnifL::Prm1 with 500bp flank | starting at 31bp after the A of the ATG start codon, 1375bp of nifL have been deleted and replaced with the CI006 Prm1 promoter sequence; 500bp flanking the nifL gene upstream and downstream are included | ds20 |
| CM093; PBC6.93 | 6-848 | SEQ ID NO 249 | glnEΔAR-2 | glnE gene with 1644bp immediately downstream of the ATG start codon deleted, resulting in a truncated glnE protein lacking the adenylyl-removing (AR) domain | ds31 |
| CM093; PBC6.93 | 6-848 | SEQ ID NO 250 | glnEΔAR-2 with 500bp flank | glnE gene with 1644bp immediately downstream of the ATG start codon deleted, resulting in a truncated glnE protein lacking the adenylyl-removing (AR) domain; 500bp flanking the glnE gene upstream and downstream are included | ds31 |
| CM093; PBC6.93 | 6-848 | SEQ ID NO 251 | ΔamtB | First 1088bp of amtB gene and 4bp upstream of start codon deleted; 199bp of gene remaining lacks a start codon; no amtB protein is translated | ds126 |
| CM093; PBC6.93 | 6-848 | SEQ ID NO 252 | ΔamtB with 500bp flank | First 1088bp of amtB gene and 4bp upstream of start codon deleted; 199bp of gene remaining lacks a start codon; no amtB protein is translated | ds126 |
| CM094: PBC6.94 | 6-881 | SEQ ID NO 253 | glnEΔAR-1 | glnE gene with 1287bp immediately downstream of the ATG start codon deleted, resulting in a truncated glnE protein lacking the adenylyl-removing (AR) domain | ds30 |
| CM094; PBC6.94 | 6-881 | SEQ ID NO 254 | glnEΔAR-1 with 500bp flank | glnE gene with 1287bp immediately downstream of the ATG start codon deleted, resulting in a truncated glnE protein lacking the adenylyl-removing (AR) domain; 500bp flanking the glnE gene upstream and downstream are included | ds30 |
| CM094; PBC6.94 | 6-881 | SEQ ID NO 255 | ΔnifL::Prm1 | starting at 31bp after the A of the ATG start codon, 1375bp of nifL have been deleted and replaced with the CI006 Prm1 promoter sequence | ds20 |

TABLE 32-continued

Remodeled Non-intergeneric Microbes

| Strain | Strain ID | SEQ ID NO | Genotype | Description | Associated Novel Junction If Applicable |
|---|---|---|---|---|---|
| CM094; PBC6.94 | 6-881 | SEQ ID NO 256 | ΔnifL::Prm1 with 500bp flank | starting at 31bp after the A of the ATG start codon, 1375bp of nifL have been deleted and replaced with the CI006 Prm1 promoter sequence; 500bp flanking the nifL gene upstream and downstream are included | ds20 |
| CM094; PBC6.94 | 6-881 | SEQ ID NO 257 | ΔamtB | First 1088bp of amtB gene and 4bp upstream of start codon deleted; 199bp of gene remaining lacks a start codon; no amtB protein is translated | ds126 |
| CM094; PBC6.94 | 6-881 | SEQ ID NO 258 | ΔamtB with 500bp flank | First 1088bp of amtB gene and 4bp upstream of start codon deleted; 199bp of gene remaining lacks a start codon; no amtB protein is translated | ds126 |
| none | 910-1246 | SEQ ID NO 259 | ΔnifL::PinfC | starting at 20bp after the A of the ATG start codon, 1379bp of nifL have been deleted and replaced with the 910 PinfC promoter sequence | ds960 |
| none | 910-1246 | SEQ ID NO 260 | ΔnifL::PinfC with 500bp flank | starting at 20bp after the A of the ATG start codon, 1379bp of nifL have been deleted and replaced with the 910 PinfC promoter sequence; 500bp flanking the nifL gene upstream and downstream are included | ds960 |
| PBC6.1, 6, CI6 | CI006 | SEQ ID NO 261 | 16S-1 | 1 of 3 unique 16S rDNA genes in the CI006 genome | N/A |
| PBC6.1, 6. CI6 | CI006 | SEQ ID NO 262 | 16S-2 | 2 of 3 unique 16S rDNA genes in the CI006 genome | N/A |
| PBC6.1. 6, CI6 | CI006 | SEQ ID NO 263 | nifH | N/A | N/A |
| PBC6.1, 6, CI6 | CI006 | SEQ ID NO 264 | nifD2 | 2 of 2 unique genes annotated as nifD in CI006 genome | N/A |
| PBC6.1, 6. CI6 | CI006 | SEQ ID NO 265 | nifK2 | 2 of 2 unique genes annotated as nifK in CI006 genome | N/A |
| PBC6.1, 6,06 | CI006 | SEQ ID NO 266 | nifL | N/A | N/A |
| PBC6.1. 6, CI6 | CI006 | SEQ ID NO 267 | nifA | N/A | N/A |
| PBC6.1, 6, CI6 | CI006 | SEQ ID NO 268 | glnE | N/A | N/A |
| PBC6.1, 6,06 | CI006 | SEQ ID NO 269 | 16S-3 | 3 of 3 unique 16S rDNA genes in the CI006 genome | N/A |
| PBC6.1, 6, CI6 | CI006 | SEQ ID NO 270 | nifD1 | 1 of 2 unique genes annotated as nifD in CI006 genome | N/A |
| PBC6.1. 6, CI6 | CI006 | SEQ ID NO 271 | nifK1 | 1 of 2 unique genes annotated as nifK in CI006 genome | N/A |
| PBC6.1, 6, CI6 | CI006 | SEQ ID NO 272 | amtB | N/A | N/A |
| PBC6.1, 6, CI6 | CI006 | SEQ ID NO 273 | Prm1 | 348bp includes the 319bp immediately upstream of the ATG start codon of the lpp gene and the first 29bp of the lpp gene | N/A |
| PBC6.1, 6, CI6 | CI006 | SEQ ID NO 274 | Prm5 | 313bp starting at 432bp upstream of the ATG start codon of the ompX gene and ending 119bp upstream of the ATG start codon of the ompX gene | N/A |
| 19, CI19 | CI019 | SEQ ID NO 275 | nifL | N/A | N/A |
| 19, CI19 | CI019 | SEQ ID NO 276 | nifA | N/A | N/A |
| 19, CI19 | CI019 | SEQ ID NO 277 | 16S-1 | 1 of 7 unique 16S rDNA genes in the CI019 genome | N/A |
| 19, CI19 | CI019 | SEQ ID NO 278 | 16S-2 | 2 of 7 unique 16S rDNA genes in the CI019 genome | N/A |
| 19, CI19 | CI019 | SEQ ID NO 279 | 16S-3 | 3 of 7 unique 16S rDNA genes in the CI019 genome | N/A |
| 19, CI19 | CI019 | SEQ ID NO 280 | 16S-4 | 4 of 7 unique 16S rDNA genes in the CI019 genome | N/A |
| 19, CI19 | CI019 | SEQ ID NO 281 | 16S-5 | 5 of 7 unique 16S rDNA genes in the CI019 genome | N/A |
| 19, CI19 | CI019 | SEQ ID NO 282 | 16S-6 | 6 of 7 unique 16S rDNA genes in the CI019 genome | N/A |

TABLE 32-continued

Remodeled Non-intergeneric Microbes

| Strain | Strain ID | SEQ ID NO | Genotype | Description | Associated Novel Junction If Applicable |
|---|---|---|---|---|---|
| 19, CI19 | CI019 | SEQ ID NO 283 | 16S-7 | 7 of 7 unique 16S rDNA genes in the CI019 genome | N/A |
| 19, CI19 | CI019 | SEQ ID NO 284 | nifH1 | 1 of 2 unique genes annotated as nifH in CI019 genome | N/A |
| 19, CI19 | CI019 | SEQ ID NO 285 | nifH2 | 2 of 2 unique genes annotated as nifH in CI019 genome | N/A |
| 19, CI19 | CI019 | SEQ ID NO 286 | nifD1 | 1 of 2 unique genes annotated as nifD in CI019 genome | N/A |
| 19, CI19 | CI019 | SEQ ID NO 287 | nifD2 | 2 of 2 unique genes annotated as nifD in CI019 genome | N/A |
| 19, CI19 | CI019 | SEQ ID NO 288 | nifK1 | 1 of 2 unique genes annotated as nifK in CI019 genome | N/A |
| 19, CI19 | CI019 | SEQ ID NO 289 | nifK2 | 2 of 2 unique genes annotated as nifK in CI019 genome | N/A |
| 19, CI19 | CI019 | SEQ ID NO 290 | glnE | N/A | N/A |
| 19, CI19 | CI019 | SEQ ID NO 291 | Prm4 | 449bp immediately upstream of the ATG of the dscC 2 gene | N/A |
| 19, CI19 | CI019 | SEQ ID NO 292 | Prm1.2 | 500bp immediately upstream of the TTG start codon of the infC gene | N/A |
| 19, CI19 | CI019 | SEQ ID NO 293 | Prm3.1 | 170 bp immediately upstream of the ATG start codon of the rplN gene | N/A |
| 19, CI20 | CI020 | SEQ ID NO 294 | Prm6.1 | 142bp immediately upstream of the ATG of a highly-expressed hypothetical protein (annotated as PROKKA_00662 in CI019 assembly 82) | N/A |
| 19, CI21 | CI021 | SEQ ID NO 295 | Prm7.1 | 293bp immediately upstream of the ATG of the lpp gene | N/A |
| 19-375, 19-417, CM067 | CM67 | SEQ ID NO 296 | glnEΔAR-2 | glnE gene with 1650bp immediately downstream of the ATG start codon deleted, resulting in a truncated glnE protein lacking the adenylyl-removing (AR) domain | ds34 |
| 19-375, 19-417, CM067 | CM67 | SEQ ID NO 297 | glnEΔAR-2 with 500bp flank | glnE gene with 1650bp immediately downstream of the ATG start codon deleted, resulting in a truncated glnE protein lacking the adenylyl-removing (AR) domain; 500bp flanking the glnE gene upstream and downstream are included | ds34 |
| 19-375, 19-417, CM067 | CM67 | SEQ ID NO 298 | ΔnifL::null-v1 | starting at 221bp after the A of the ATG start codon, 845bp of nifL have been deleted and replaced with the 31bp sequence "GGAGTCTGAACTCATCCTGCGATGGGGGCTG" | none |
| 19-375, 19-417, CM067 | CM67 | SEQ ID NO 299 | ΔnifL::null-v1 with 500bp flank | starting at 221bp after the A of the ATG start codon, 845bp of nifL have been deleted and replaced with the 31bp sequence "GGAGTCTGAACTCATCCTGCGATGGGGGCTG"; 500bp flanking the nifL gene upstream and downstream are included | none |
| 19-377, CM069 | CM69 | SEQ ID NO 300 | ΔnifL::null-v2 | starting at 221bp after the A of the ATG start codon, 845bp of nifL have been deleted and replaced with the 5bp sequence "TTAAA" | none |
| 19-377, CM069 | CM69 | SEQ ID NO 301 | ΔnifL::null-v2 with 500bp flank | starting at 221bp after the A of the ATG start codon, 845bp of nifL have been deleted and replaced with the 5bp sequence "TTAAA"; 500bp flanking the nifL gene upstream and downstream are included | none |
| 19-389, 19-418, CM081 | CM81 | SEQ ID NO 302 | ΔnifL::Prm4 | starting at 221bp after the A of the ATG start codon, 845bp of nifL have been deleted and replaced with the CI19 Prm4 sequence | ds70 |

TABLE 32-continued

Remodeled Non-intergeneric Microbes

| Strain | Strain ID | SEQ ID NO | Genotype | Description | Associated Novel Junction If Applicable |
|---|---|---|---|---|---|
| 19-389, 19-418, CM081 | CM81 | SEQ ID NO 303 | ΔnifL::Prm4 with 500bp flank | starting at 221bp after the A of the ATG start codon, 845bp of nifL have been deleted and replaced with the CI19 Prm4 sequence; 500bp flanking the nifL gene upstream and downstream are included | ds70 |
| | 137-2084 | SEQ ID NO 191 | glnE_KO2 | glnE gene with 1290bp immediately downstream of the ATG start codon deleted, resulting in a truncated glnE protein lacking the adenylyl-removing (AR) domain | ds809 |
| | 137-2084 | SEQ ID NO 192 | glnE_KO2 with 500bp flank | glnE gene with 1290bp immediately downstream of the ATG start codon deleted, resulting in a truncated glnE protein lacking the adenylyl-removing (AR) domain; 500bp flanking the glnE gene upstream and downstream are included | ds809 |
| | 137-2084 | SEQ ID NO 203 | ΔnifL-Prm1.2 | starting at 24bp after the A of the ATG start codon, 1372bp of nifL have been deleted and replaced with the 137 Prm1.2 promoter sequence | ds843 |
| | 137-2084 | SEQ ID NO 204 | ΔnifL-Prm1.2 with 500bp flank | starting at 24bp after the A of the ATG start codon, 1372bp of nifL have been deleted and replaced with the 137 Prm1.2 promoter sequence; 500bp flanking the nifL gene upstream and downstream are included | ds843 |
| | 137-2237 | SEQ ID NO 191 | glnE_KO2 | glnE gene with 1290bp immediately downstream of the ATG start codon deleted, resulting in a truncated glnE protein lacking the adenylyl-removing (AR) domain | ds809 |
| | 137-2237 | SEQ ID NO 192 | glnE_KO2 with 500bp flank | glnE gene with 1290bp immediately downstream of the ATG start codon deleted, resulting in a truncated glnE protein lacking the adenylyl-removing (AR) domain; 500bp flanking the glnE gene upstream and downstream are included | ds809 |
| | 137-2237 | SEQ ID NO 203 | ΔnifL-Prm1.2 | starting at 24bp after the A of the ATG start codon, 1372bp of nifL have been deleted and replaced with the 137 Prm1.2 promoter sequence | ds843 |
| | 137-2237 | SEQ ID NO 204 | ΔnifL-Prm1.2 with 500bp flank | starting at 24bp after the A of the ATG start codon, 1372bp of nifL have been deleted and replaced with the 137 Prm1.2 promoter sequence; 500bp flanking the nifL gene upstream and downstream are included | ds843 |
| | 137-2237 | SEQ ID NO 431 | glsA2::Prm1.2_ATG-start | 81bp immediately upstream of the ATG start codon were deleted and replaced with the 137 Prm1.2 promoter sequence | ds2551 |
| | 137-2237 | SEQ ID NO 432 | glsA2::Prm1.2_ATG-start with 500bp flank | 81bp immediately upstream of the ATG start codon were deleted and replaced with the 137 Prm1.2 promoter sequence; 500bp flanking the Prm1.2 promoter and glsA2 gene upstream and downstream are included | ds2551 |

Example 7: Guided Microbial Remodeling Campaign for the Rational Improvement of Multiple Phenotypic Traits In this example, Steps A-F described in Example 1 were used to generate several non-transgenic derivative strains of *Klebsiella variicola* Wild type (WT) strain, CI137. First, the WT strain, CI137, was isolated from a rhizosphere, charac-terized, and domesticated using the approaches described in steps A-C of Example 1.

Then using the approaches described in steps D-F of Example 1, multiple phenotypic traits of CI137 were ratio-nally improved without the use of transgenes. For example, to test whether the nitrogen fixation trait of the WT strain can be improved, various genes involved in nitrogen fixation as described throughout this application were targeted to engi-neer non-intergeneric mutations, the engineered/remodeled microbes were analyzed for nitrogen fixation, and the engineering and the analytics steps were iterated to test whether further improvements can be made in the nitrogen fixation ability. Once substantial improvement in the nitrogen fixation ability was achieved for a remodeled strain of CI137, the microbes were assessed for the colonization trait. As the remodeled strains with improved nitrogen fixation showed lower colonization than the WT strain, genes involved in colonization as described in this application were targeted to engineer non-intergeneric mutations to improve colonization, the engineered/remodeled microbes were analyzed for colonization, and the engineering and the analytics steps were iterated.

To generate non-intergeneric mutations through the iterative remodeling process, two approaches were employed to remodel the underlying genetic architecture of the microbe: (1) creating markerless deletions of genomic sequences encoding protein domains or whole genes, and (2) rewiring regulatory networks by intragenomic promoter rearrangement.

The remodeled strains of CI137 obtained through this iterative remodeling process that showed improvement in nitrogen fixation and/or colonization are described below.

Figure 26:
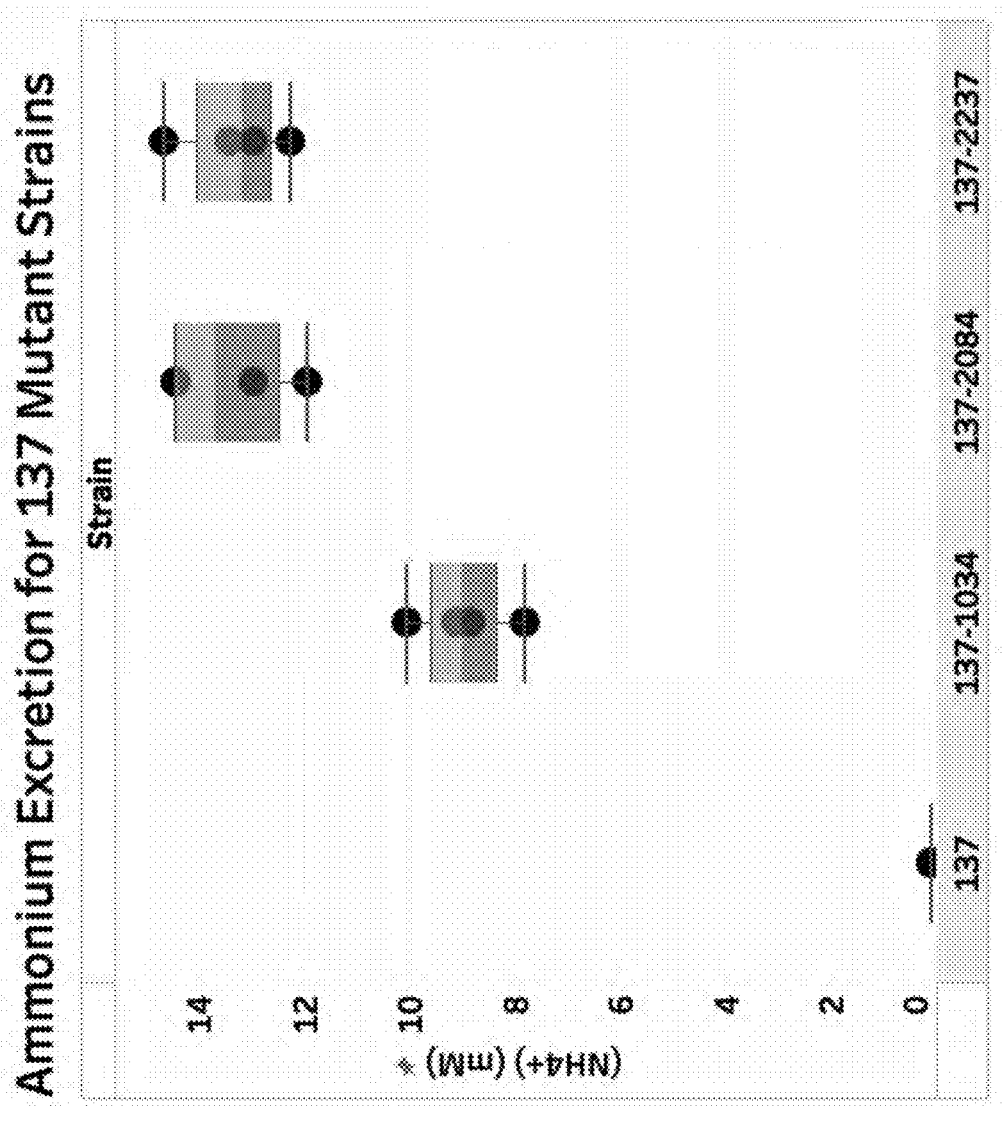
FIG. 26 illustrates excretion of ammonia excretion by WT CI137 and mutant strains described in Example 7. The WT strain was observed not to excrete ammonia, and negligible ammonia accumulates in the media.
Figure 27:
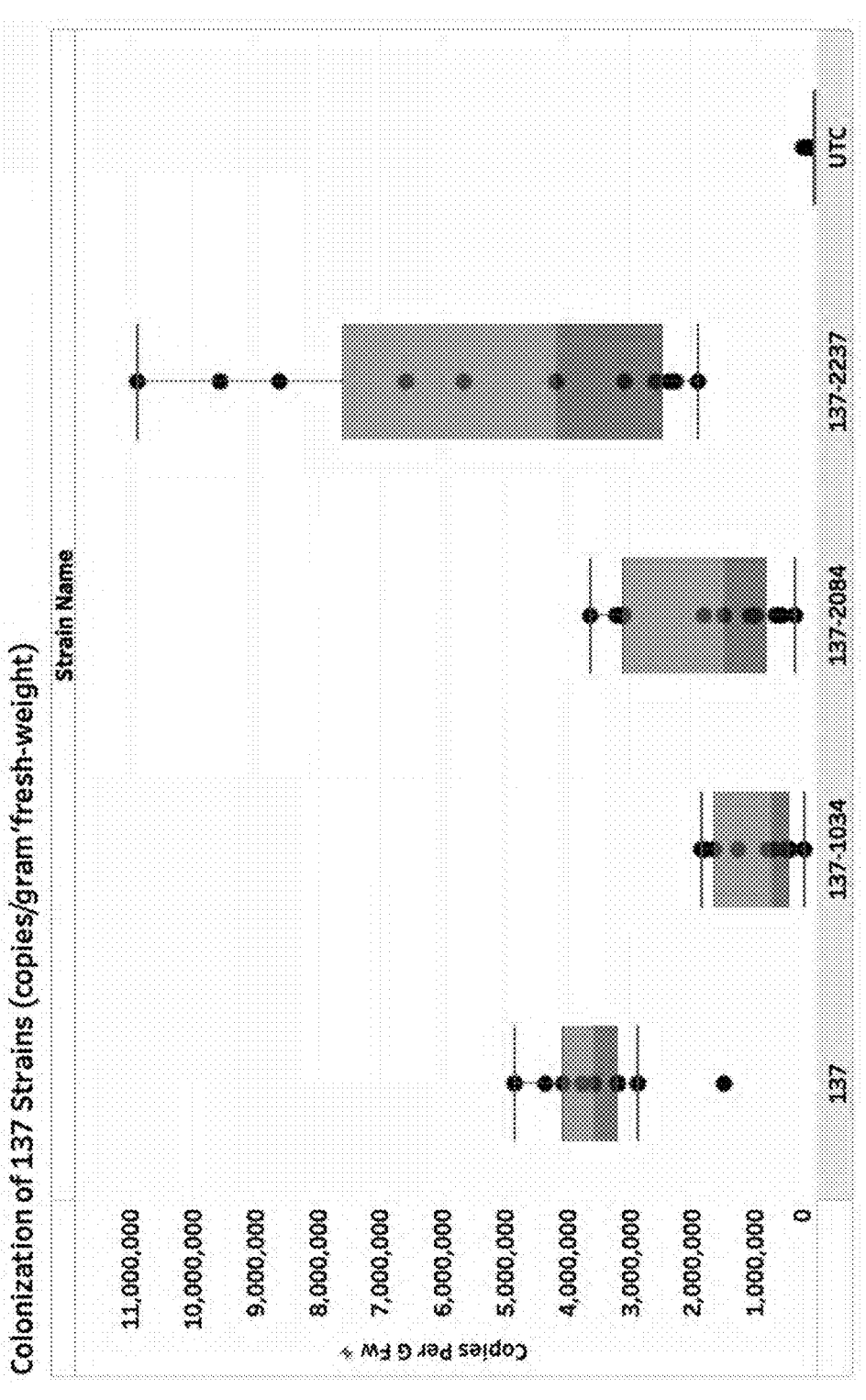
FIG. 27 illustrates microbial colonization in corn three weeks after planting. The corn seed was inoculated at planting by CI137 WT and derivative strains described in Example 7.
Figure 28:
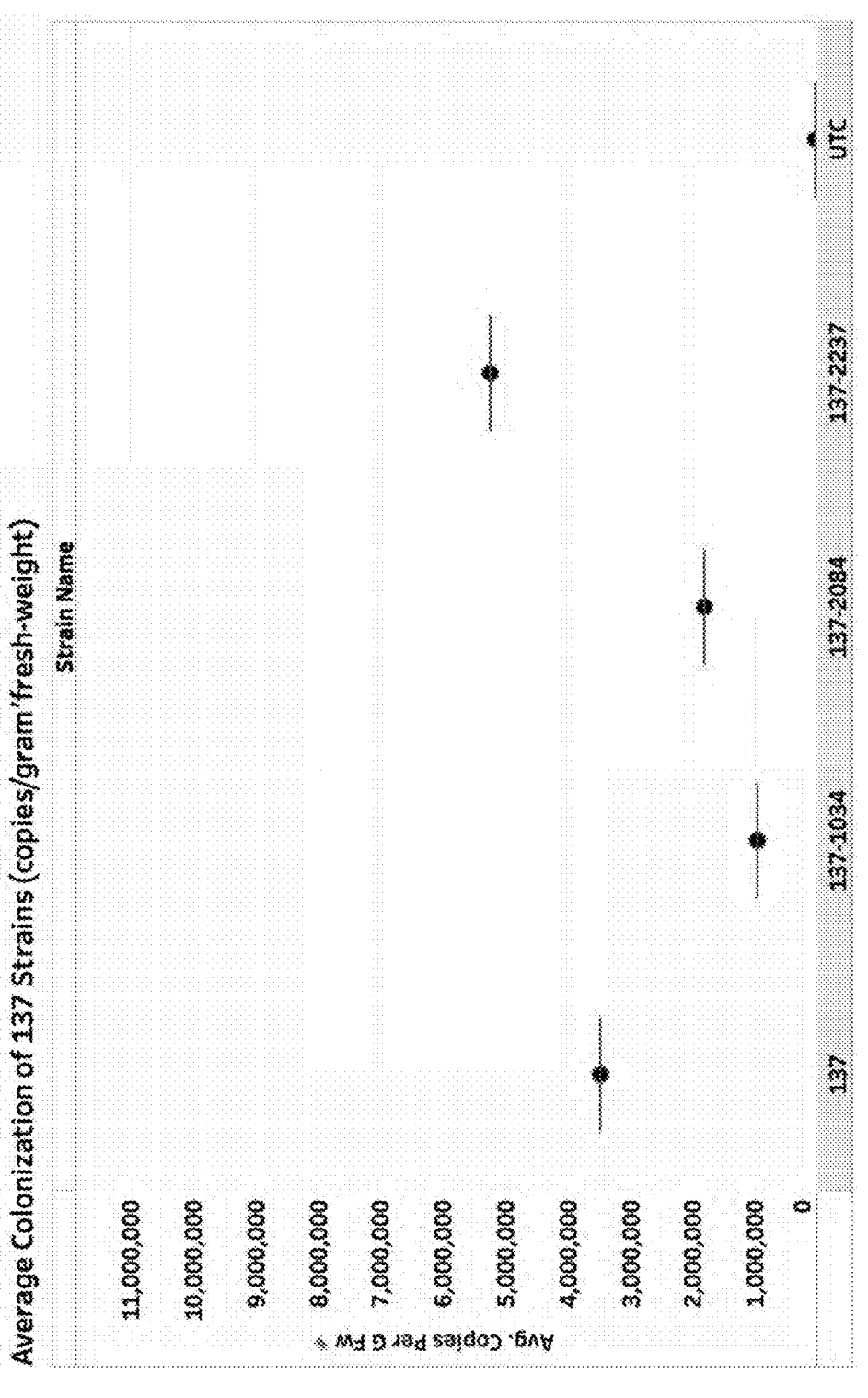
FIG. 28 illustrates the same data from FIG. 27 but in a slightly different way.

To test whether the nitrogen fixation trait of the WT strain, CI137, can be improved, a 1647 basepair region after the start codon of the glnE gene was deleted to produce a truncated GlnE protein that does not comprise the adenylyl-removing (AR) domain resulting in a constitutively adenylylated glutamine synthetase. This remodeled CI137 is referred to herein as 137-1034. 137-1034 could excrete ammonia whereas the WT strain did not excrete ammonia (FIG. 26). However, 137-1034 showed reduced colonization compared to the WT strain (FIGS. 27-28). The step of generating non-intergeneric mutations was iterated to further remodel 137-1034 and to test if any improvement in ammonia excretion can be obtained. For this, the nifL gene was deleted from 20 bp after the ATG start codon to 87 bp before the TGA stop codon and a 400 bp fragment from the region upstream of the cspE gene containing a promoter of the cspE gene was inserted (Prm1.2) upstream of nifA replacing the deleted portion. This remodeled microbe is referred to herein as 137-2084. This strain showed improved ammonia excretion over 137-1034 (FIG. 26). When tested for colonization potential, 137-2084 showed slightly improved colonization compared to 137-1034; however, its colonization potential was still lower by~ 10-fold compared to the WT strain (FIGS. 27-28). The step of generating non-intergeneric mutations was iterated/repeated to test whether both the colonization potential and ammonia excretion could be improved. Specifically, the nifL gene was deleted from 20 bp after the ATG start codon to 87 bp before the TGA stop codon; a 400 bp fragment from the region upstream of the cspE gene containing a promoter of the cspE gene was inserted (Prm1.2) upstream of nifA replacing the deleted portion; and a 400 bp fragment from the region upstream of the cspE gene containing a promoter of the cspE gene was inserted (Prm1.2) upstream of the glsA2 gene replacing the native promoter of the gene. This strain is referred to herein as 137-2237. 137-2237 showed similar levels of improved ammonia excretion as 137-2084 (FIG. 26) and at the same time, the colonization potential of 137-2237 was similar or slightly improved compared to the WT strain (FIGS. 27-28).

The above description illustrates how steps D-F described in Example 1 can be used to iterate non-intergeneric mutations to stack improvements in multiple traits in remodeled microbes. The ammonia excretion assay used here is as described in Example 2.

Colonization Assay

Briefly, strains were grown overnight in rich media (SOB). Optical densities of culture media containing respective strains were measured, normalized to 1 and and 1 mL of the culture medium was used to inoculate a corn seed during planting in a grow-pot. Plants were grown for 3 weeks, then de-potted, and roots were washed to remove loose sand and debris. Samples of root tissue were taken from the seminal root and first node (found 1-2 inches below the crown), washed in PBS, and a gDNA prep was done on the solution.

Cells per gram/fresh weight was determined by running the gDNA preps through qPCR using strain specific primers. A more detailed description of the assay can be found in a PCT publication, WO/2019/032926, incorporated by reference herein in its entirety.

The above-described mutations made to the CI137 WT strain are summarized in Table 33 below.

TABLE 33

List of isolated and derivative *K. variicola* strains

| Strain ID | Genotype | Mutation | Mutation Description |
|---|---|---|---|
| 137 | WT | WT | Wild type *Klebsiella variicola* strain. |
| 137-1034 | ΔglnE$_{AR}$-KO2 | ΔglnE$_{AR}$-KO2 | Deletion of 1647bp after the start codon of the glnE gene. |
| 137-2084 | ΔnifL::Prm1.2, ΔglnE$_{AR}$-KO2, | ΔnifL::Prm1.2 | Deletion of the nifL gene from 20bp after the ATG (start) to 87bp before the TGA (stop) of the gene. A 400bp fragment from the region upstream of the cspE gene containing a promoter of the cspE gene was inserted (Prm1.2) upstream of nifA replacing the deleted portion. |
| | | ΔglnE$_{AR}$-KO2 | Deletion of 1647bp after the start codon of the glnE gene. |
| 137-2337 | ΔnifL::Prm1.2, ΔglnE$_{AR}$-KO2, glsA2::Prm1.2 | ΔnifL::Prm1.2 | Deletion of the nifL gene from 20bp after the ATG (start) to 87bp before the TGA (stop) of the gene. A 400bp fragment from the region upstream of the cspE gene containing a promoter of the cspE gene was inserted (Prm1.2) upstream of nifA replacing the deleted portion. |
| | | ΔglnE$_{AR}$-KO2 | Deletion of 1647bp after the start codon of the glnE gene. |

TABLE 33-continued

| List of isolated and derivative _K. variicola_ strains | | | |
| --- | --- | --- | --- |
| Strain ID | Genotype | Mutation | Mutation Description |
| | | glsA2::Prm1.2 | A 400bp fragment from the region upstream of the cspE gene containing a promoter of the cspE gene was inserted (Prm1.2) upstream of the glsA2 gene replacing the native promoter of the gene. |

NUMBERED EMBODIMENTS OF THE DISCLOSURE

Notwithstanding the appended claims, the disclosure sets forth the following numbered embodiments:

1. A guided microbial remodeling method for the rational improvement of plant-associated microbes to perform plant-beneficial functions, comprising:
   a. providing a plurality of microbial species that are associated with a target plant of interest;
   b. sequencing the genomes of the plurality of microbial species and characterizing one or more genomic pathways, or sets of genes, that are associated with a plant-beneficial function of interest;
   c. assaying the plurality of microbial species for: colonization metrics, transcriptionally active genes under metabolically relevant environmental conditions, and ability to perform a plant-beneficial function of interest;
   d. selecting a candidate microbial species from the plurality of assayed microbial species;
   e. transforming the candidate microbial species with a transformation plasmid comprising:
      i. a selection marker,
      ii. a counterselection marker,
      iii. a DNA fragment comprising: a non-intergeneric genetic variation to be introduced into the candidate microbial species at a target genomic locus in one or more genomic pathways, or sets of genes, that are associated with a plant-beneficial function of interest, and homology arms to the target genomic locus flanking the non-intergeneric genetic variation; and
      iv. plasmid backbone,
   f. selecting for a candidate microbial species that has undergone an initial homologous recombination and has the non-intergeneric genetic variation integrated into the target genomic locus based on the presence of the selection marker in the genome;
   g. selecting for a candidate microbial species that has the non-intergeneric genetic variation integrated into the target genomic locus, but has undergone an additional homologous recombination that loops-out the plasmid backbone, based on the absence of the counterselection marker;
   h. sequencing the genome of the transformed candidate microbial species and confirming integration of the non-intergeneric genetic variation at the target genomic locus and absence of any genetic sequence from the transformation plasmid; and
   i. repeating steps e)-h) one or more times, until a candidate microbial species has acquired an improved ability to perform the plant-beneficial function of interest.

2. The guided microbial remodeling method according to embodiment 1, wherein the plant-beneficial function of interest is nitrogen fixation.

3. The guided microbial remodeling method according to embodiment 1, wherein the plant-beneficial function of interest is phosphate solubilization.

4. The guided microbial remodeling method according to embodiment 1, wherein the plant-beneficial function of interest is microbial colonization.

5. The guided microbial remodeling method according to any one of the embodiments 1-4, wherein step b) comprises whole genome sequencing.

6. The guided microbial remodeling method according to any one of the embodiments 1-5, wherein step b) comprises characterizing the nitrogen fixation pathway.

7. The guided microbial remodeling method according to any one of the embodiments 1-6, wherein step b) comprises characterizing a set of genes selected from the group consisting of: nifA, nifL, ntrB, ntrC, polynucleotide encoding glutamine synthetase, glnA, glnB, glnK, drat, amtB, polynucleotide encoding glutaminase, glnD, glnE, nifJ, nifH, nifD, nifK, nifY, nifE, nifN, nifU, nifS, nifV, nifW, nifZ, nifM, nifF, nifB, nifQ, a gene associated with biosynthesis of a nitrogenase enzyme, and combinations thereof.

8. The guided microbial remodeling method according to any one of the embodiments 1-7, wherein step c) comprises assaying the plurality of microbial species for colonization metrics under greenhouse or lab based conditions.

9. The guided microbial remodeling method according to any one of the embodiments 1-7, wherein step c) comprises assaying the plurality of microbial species for colonization metrics under field conditions.

10. The guided microbial remodeling method according to any one of the embodiments 1-7, wherein step c) comprises assaying the plurality of microbial species for colonization metrics under greenhouse or lab based conditions, and also under field conditions.

11. The guided microbial remodeling method according to any one of the embodiments 1-10, wherein a colonization metric assayed in step c) comprises at least one of the following: spatial colonization patterns, temporal colonization dynamics, density of colonization, or combinations thereof.

12. The guided microbial remodeling method according to any one of the embodiments 1-11, wherein assaying the plurality of microbial species for transcriptionally active genes under metabolically relevant environmental conditions in step c) occurs under greenhouse or lab based conditions.

13. The guided microbial remodeling method according to any one of the embodiments 1-11, wherein assaying the plurality of microbial species for transcriptionally active genes under metabolically relevant environmental conditions in step c) occurs under greenhouse or lab based conditions and comprises measuring the transcriptomic profile of the microbial species.

14. The guided microbial remodeling method according to any one of the embodiments 1-11, wherein assaying the plurality of microbial species for transcriptionally active genes under metabolically relevant environmental conditions in step c) occurs under greenhouse or lab based conditions and comprises measuring the transcriptomic activity of genes associated with the microbial species ability to perform a plant-beneficial function of interest.

15. The guided microbial remodeling method according to any one of the embodiments 1-11, wherein assaying the plurality of microbial species for transcriptionally active genes under metabolically relevant environmental conditions in step c) occurs under greenhouse or lab based conditions and comprises measuring the transcriptomic activity of regulatory gene sequences.

16. The guided microbial remodeling method according to any one of the embodiments 1-11, wherein assaying the plurality of microbial species for transcriptionally active genes under metabolically relevant environmental conditions in step c) occurs under greenhouse or lab based conditions and comprises measuring the transcriptomic activity of promoter sequences.

17. The guided microbial remodeling method according to any one of the embodiments 1-11, wherein assaying the plurality of microbial species for transcriptionally active genes under metabolically relevant environmental conditions in step c) occurs under greenhouse or lab based conditions and comprises measuring the transcriptomic activity of promoter sequences in the presence of exogenous nitrogen.

18. The guided microbial remodeling method according to any one of the embodiments 1-11, wherein assaying the plurality of microbial species for transcriptionally active genes under metabolically relevant environmental conditions in step c) occurs under greenhouse or lab based conditions and comprises measuring the transcriptomic activity of promoter sequences in the presence of exogenous nitrogen, wherein said transcriptomic activity of the promoter sequences is measured by quantifying the expression of a regulated gene.

19. The guided microbial remodeling method according to any one of the embodiments 1-11, wherein assaying the plurality of microbial species for transcriptionally active genes under metabolically relevant environmental conditions in step c) occurs under field conditions.

20. The guided microbial remodeling method according to any one of the embodiments 1-11, wherein assaying the plurality of microbial species for transcriptionally active genes under metabolically relevant environmental conditions in step c) occurs under field conditions and comprises measuring the transcriptomic profile of the microbial species.

21. The guided microbial remodeling method according to any one of the embodiments 1-11, wherein assaying the plurality of microbial species for transcriptionally active genes under metabolically relevant environmental conditions in step c) occurs under field conditions and comprises measuring the transcriptomic activity of genes associated with the microbial species ability to perform a plant-beneficial function of interest.

22. The guided microbial remodeling method according to any one of the embodiments 1-11, wherein assaying the plurality of microbial species for transcriptionally active genes under metabolically relevant environmental conditions in step c) occurs under field conditions and comprises measuring the transcriptomic activity of regulatory gene sequences.

23. The guided microbial remodeling method according to any one of the embodiments 1-11, wherein assaying the plurality of microbial species for transcriptionally active genes under metabolically relevant environmental conditions in step c) occurs under field conditions and comprises measuring the transcriptomic activity of promoter sequences.

24. The guided microbial remodeling method according to any one of the embodiments 1-11, wherein assaying the plurality of microbial species for transcriptionally active genes under metabolically relevant environmental conditions in step c) occurs under field conditions and comprises measuring the transcriptomic activity of promoter sequences in the presence of exogenous nitrogen.

25. The guided microbial remodeling method according to any one of the embodiments 1-11, wherein assaying the plurality of microbial species for transcriptionally active genes under metabolically relevant environmental conditions in step c) occurs under field conditions and comprises measuring the transcriptomic activity of promoter sequences in the presence of exogenous nitrogen, wherein said transcriptomic activity of the promoter sequences is measured by quantifying the expression of a regulated gene.

26. The guided microbial remodeling method according to any one of the embodiments 1-11, wherein assaying the plurality of microbial species for transcriptionally active genes under metabolically relevant environmental conditions in step c) occurs in vitro.

27. The guided microbial remodeling method according to any one of the embodiments 1-11, wherein assaying the plurality of microbial species for transcriptionally active genes under metabolically relevant environmental conditions in step c) occurs in vitro and comprises measuring the transcriptomic profile of the microbial species.

28. The guided microbial remodeling method according to any one of the embodiments 1-11, wherein assaying the plurality of microbial species for transcriptionally active genes under metabolically relevant environmental conditions in step c) occurs in vitro and comprises measuring the transcriptomic activity of genes associated with the microbial species ability to perform a plant-beneficial function of interest.

29. The guided microbial remodeling method according to any one of the embodiments 1-11, wherein assaying the plurality of microbial species for transcriptionally active genes under metabolically relevant environmental conditions in step c) occurs in vitro and comprises measuring the transcriptomic activity of regulatory gene sequences.

30. The guided microbial remodeling method according to any one of the embodiments 1-11, wherein assaying the plurality of microbial species for transcriptionally active genes under metabolically relevant environmental conditions in step c) occurs in vitro and comprises measuring the transcriptomic activity of promoter sequences.

31. The guided microbial remodeling method according to any one of the embodiments 1-11, wherein assaying the plurality of microbial species for transcriptionally active genes under metabolically relevant environmental conditions in step c) occurs in vitro and comprises measuring the transcriptomic activity of promoter sequences in N-depleted and N-replete conditions.

32. The guided microbial remodeling method according to any one of the embodiments 1-11, wherein assaying the plurality of microbial species for transcriptionally active genes under metabolically relevant environmental conditions in step c) occurs in vitro and comprises measuring the transcriptomic activity of promoter sequences in N-depleted and N-replete conditions, wherein said transcriptomic activity of the promoter sequences is measured by quantifying the expression of a regulated gene.

33. The guided microbial remodeling method according to any one of the embodiments 1-7, wherein assaying the plurality of microbial species for colonization metrics, comprises: growing said plurality of microbial species in intimate association with a target plant.

34. The guided microbial remodeling method according to any one of the embodiments 1-7, wherein assaying the plurality of microbial species for colonization metrics, comprises: growing said plurality of microbial species in intimate association with a target plant under greenhouse or lab based conditions.

35. The guided microbial remodeling method according to any one of the embodiments 1-7, wherein assaying the plurality of microbial species for colonization metrics, comprises: growing said plurality of microbial species in intimate association with a target plant under field conditions.

36. The guided microbial remodeling method according to any one of the embodiments 1-7, wherein assaying the plurality of microbial species for transcriptionally active genes under metabolically relevant environmental conditions, comprises: growing said plurality of microbial species in intimate association with a target plant.

37. The guided microbial remodeling method according to any one of the embodiments 1-7, wherein assaying the plurality of microbial species for transcriptionally active genes under metabolically relevant environmental conditions, comprises: growing said plurality of microbial species in intimate association with a target plant under greenhouse or lab based conditions.

38. The guided microbial remodeling method according to any one of the embodiments 1-7, wherein assaying the plurality of microbial species for transcriptionally active genes under metabolically relevant environmental conditions, comprises: growing said plurality of microbial species in intimate association with a target plant under field conditions.

39. The guided microbial remodeling method according to any one of the embodiments 1-7, wherein assaying the plurality of microbial species for colonization metrics and transcriptionally active genes under metabolically relevant environmental conditions, comprises: growing said plurality of microbial species in intimate association with a target plant under field conditions.

40. The guided microbial remodeling method according to any one of the embodiments 1-7, wherein step c) comprises assaying the plurality of microbial species for ability to perform a plant-beneficial function of interest under greenhouse or lab based conditions.

41. The guided microbial remodeling method according to any one of the embodiments 1-7, wherein step c) comprises assaying the plurality of microbial species for nitrogen fixation activity.

42. The guided microbial remodeling method according to any one of the embodiments 1-7, wherein step c) comprises assaying the plurality of microbial species for nitrogen fixation activity in an acetylene reduction assay or ammonium excretion assay.

43. The guided microbial remodeling method according to any one of the embodiments 1-42, wherein the transformation plasmid of step e) is a suicide plasmid.

44. The guided microbial remodeling method according to any one of the embodiments 1-43, wherein step h) comprises whole genome sequencing.

45. A guided microbial remodeling method for the rational improvement of plant-associated microbes to perform plant-beneficial functions, comprising:
    a. providing a plurality of microbial species;
    b. assaying the plurality of microbial species for: colonization metrics, transcriptionally active genes under metabolically relevant environmental conditions, and ability to perform a plant-beneficial function of interest;
    c. selecting a candidate microbial species from the plurality of assayed microbial species;
    d. introducing one or more targeted non-intergeneric genetic variations into the candidate microbial species at a target genomic locus in one or more genomic pathways, or sets of genes, that are associated with a plant-beneficial function of interest, said non-intergeneric genetic variations selected from the group consisting of: full gene deletions, partial gene deletions, promoter insertions, single base pair changes, and combinations thereof;
    e. sequencing the genome of the candidate microbial species and confirming integration of the non-intergeneric genetic variation at the target genomic locus and absence of any transgenic genetic sequence; and
    f. repeating steps d)-e) one or more times, until a candidate microbial species has acquired an improved ability to perform the plant-beneficial function of interest.

46. A guided microbial remodeling method for the rational improvement of plant-associated microbes to perform plant-beneficial functions, comprising:
    a. providing a plurality of microbial species;
    b. assaying the plurality of microbial species for: colonization metrics, transcriptionally active genes under metabolically relevant environmental conditions, and ability to perform a plant-beneficial function of interest;
    c. selecting a candidate microbial species from the plurality of assayed microbial species;
    d. introducing two or more targeted non-intergeneric genetic variations into the candidate microbial species at two or more target genomic loci, in one or more genomic pathways, or sets of genes, that are associated with a plant-beneficial function of interest, said non-intergeneric genetic variations selected from the group consisting of: full gene deletions, partial gene deletions, promoter insertions, single base pair changes, and combinations thereof, and
    e. sequencing the genome of the candidate microbial species and confirming introduction of the non-intergeneric genetic variations at the target genomic loci and absence of any transgenic genetic sequence.

47. A computationally guided microbial remodeling method for the rational improvement of plant-associated microbes to perform plant-beneficial functions, comprising:

a. accessing a plurality of microbial whole genome sequences;

b. identifying a plurality of regulatory gene sequences that actively regulate the transcription of a gene under a metabolically relevant environmental condition;

c. identifying a plurality of genes associated with a plant-beneficial function;

d. selecting a regulatory gene sequence and a gene associated with a plant-beneficial function from said pluralities; wherein steps a)-d) occur in silico; and e. manufacturing, in vivo, a remodeled microbial cell that has the selected regulatory gene sequence operably linked to the selected gene associated with a plant-beneficial function, thereby improving the expression of the gene associated with a plant-beneficial function.

48. A computationally guided microbial remodeling system for the rational improvement of plant-associated microbes to perform plant-beneficial functions, comprising:

a. one or more processors; and b. one or more memories operatively coupled to the one or more processors and having instructions stored thereon, that when executed by the one or more processors, cause the system to:

i. access a plurality of microbial whole genome sequences;

ii. identify a plurality of regulatory gene sequences that actively regulate the transcription of a gene under a metabolically relevant environmental condition;

iii. identify a plurality of genes associated with a plant-beneficial function; and iv. select a regulatory gene sequence and a gene associated with a plant-beneficial function from said pluralities.

49. A computationally guided microbial remodeling method for the rational improvement of plant-associated microbes to perform plant-beneficial functions, comprising:

a. activating a computer system having: one or more processors and one or more memories operatively coupled to the one or more processors and having instructions stored thereon, thereby causing the one or more processors to execute the instructions, and cause the system to:

i. access a plurality of microbial whole genome sequences;

ii. identify a plurality of regulatory gene sequences that actively regulate the transcription of a gene under a metabolically relevant environmental condition;

iii. identify a plurality of genes associated with a plant-beneficial function;

iv. select a regulatory gene sequence and a gene associated with a plant-beneficial function from said pluralities; and b. manufacturing, in vivo, a remodeled microbial cell that has the selected regulatory gene sequence operably linked to the selected gene associated with a plant-beneficial function, thereby improving the expression of the gene associated with a plant-beneficial function.

50. A guided microbial remodeling method for the rational improvement of plant-associated microbes to perform plant-beneficial functions, comprising:

a. providing a plurality of microbial species that are associated with a target plant of interest;

b. assaying the plurality of microbial species for: colonization metrics, and ability to perform a plant-beneficial function of interest;

c. selecting a candidate microbial species from the plurality of assayed microbial species;

d. introducing one or more targeted non-intergeneric genetic variations into the candidate microbial species;

e. confirming integration of the non-intergeneric genetic variation at the target genomic locus and absence of any transgenetic sequence; and f. repeating steps d) and e) one or more times, until the candidate microbial species has acquired an improved ability to perform the plant-beneficial function of interest.

51. The guided microbial remodeling method according to embodiment 50, wherein the step b) comprises assaying the plurality of microbial species for transcriptionally active genes under metabolically relevant environmental conditions.

52. The guided microbial remodeling method according to embodiment 50, comprising a step of sequencing the genomes of the plurality of microbial species obtained in step a) and characterizing one or more genomic pathways, or sets of genes, that are associated with a plant-beneficial function of interest.

53. The guided microbial remodeling method according to embodiment 50, wherein the step d) of introducing one or more targeted non-intergeneric genetic variations into the candidate microbial species comprises:

a. transforming the candidate microbial species with a transformation plasmid comprising:

i. a selection marker, ii. a counterselection marker, iii. a DNA fragment comprising: a non-intergeneric genetic variation to be introduced into the candidate microbial species at a target genomic locus in one or more genomic pathways, or sets of genes, that are associated with a plant-beneficial function of interest, and homology arms to the target genomic locus flanking the non-intergeneric genetic variation, and iv. plasmid backbone;

b. selecting for a candidate microbial species that has undergone an initial homologous recombination and has the non-intergeneric genetic variation integrated into the target genomic locus based on the presence of the selection marker in the genome; and c. selecting for a candidate microbial species that has the non-intergeneric genetic variation integrated into the target genomic locus, but has undergone an additional homologous recombination that loops-out the plasmid backbone, based on the absence of the counterselection marker.

54. The guided microbial remodeling method according to embodiment 50, wherein the step e) of confirming integration of the non-intergeneric genetic variation at the target genomic locus and absence of any transgenetic sequence comprises sequencing the genome of the transformed candidate microbial species.

55. The guided microbial remodeling method according to embodiment 50, wherein the step e) comprises confirming absence of any transgenetic sequence from the transformation plasmid.

56. The guided microbial remodeling method according to embodiment 50, wherein the plant-beneficial function of interest is nitrogen fixation.

57. The guided microbial remodeling method according to embodiment 50, wherein the plant-beneficial function of interest is phosphate solubilization.

58. The guided microbial remodeling method according to embodiment 50, wherein the plant-beneficial function of interest is microbial colonization.

59. The guided microbial remodeling method according to embodiment 52, wherein the step of sequencing comprises whole genome sequencing.

60. The guided microbial remodeling method according to embodiment 52, comprising characterizing the nitrogen fixation pathway.

61. The guided microbial remodeling method according to embodiment 52, comprising characterizing a set of genes selected from the group consisting of: nifA, nifL, ntrB, ntrC, polynucleotide encoding glutamine synthetase, glnA, glnB, glnK, drat, amtB, polynucleotide encoding glutaminase, glnD, glnE, nifJ, nifH, nifD, nifK, nifY, nifE, nifN, nifU, nifS, nifV, nifW, nifZ, nifM, nifF, nifB, nifQ, a gene associated with biosynthesis of a nitrogenase enzyme, and combinations thereof.

62. The guided microbial remodeling method according to embodiment 52, comprising characterizing one or more genes involved in a pathway selected from the group consisting of: exopolysaccharide production, endo-polygalaturonase production, trehalose production, and glutamine conversion.

63. The guided microbial remodeling method according to embodiment 52, comprising characterizing one or more genes selected from the group consisting of: bcsii, bcsiii, yjbE, fhaB, pehA, otsB, treZ, glsA2, and combinations thereof.

64. The guided microbial remodeling method according to embodiment 52, comprising characterizing one or more genes selected from the group consisting of: nifA, nifL, ntrB, ntrC, polynucleotide encoding glutamine synthetase, glnA, glnB, glnK, drat, amtB, polynucleotide encoding glutaminase, glnD, glnE, nifJ, nifH, nifD, nifK, nifY, nifE, nifN, nifU, nifS, nifV, nifW, nifZ, nifM, nifF, nifB, nifQ, a gene associated with biosynthesis of a nitrogenase enzyme, bcsii, bcsiii, yjbE, fhaB, pehA, otsB, treZ, glsA2, and combinations thereof.

65. The guided microbial remodeling method according to embodiment 50, wherein step b) comprises assaying the plurality of microbial species for colonization metrics under greenhouse or lab based conditions.

66. The guided microbial remodeling method according to embodiment 50, wherein step b) comprises assaying the plurality of microbial species for colonization metrics under field conditions.

67. The guided microbial remodeling method according to embodiment 50, wherein step b) comprises assaying the plurality of microbial species for colonization metrics under greenhouse or lab based conditions, and also under field conditions.

68. The guided microbial remodeling method according to embodiment 50, wherein a colonization metric assayed in step b) comprises at least one of the following: spatial colonization patterns, temporal colonization dynamics, density of colonization, or combinations thereof.

69. The guided microbial remodeling method according to embodiment 51, wherein assaying the plurality of microbial species for transcriptionally active genes under metabolically relevant environmental conditions occurs under greenhouse or lab based conditions.

70. The guided microbial remodeling method according to embodiment 51, wherein assaying the plurality of microbial species for transcriptionally active genes under metabolically relevant environmental conditions occurs under greenhouse or lab based conditions and comprises measuring the transcriptomic profile of the microbial species.

71. The guided microbial remodeling method according to embodiment 51, wherein assaying the plurality of microbial species for transcriptionally active genes under metabolically relevant environmental conditions occurs under greenhouse or lab based conditions and comprises measuring the transcriptomic activity of genes associated with the microbial species ability to perform a plant-beneficial function of interest.

72. The guided microbial remodeling method according to embodiment 51, wherein assaying the plurality of microbial species for transcriptionally active genes under metabolically relevant environmental conditions occurs under greenhouse or lab based conditions and comprises measuring the transcriptomic activity of regulatory gene sequences.

73. The guided microbial remodeling method according to embodiment 51, wherein assaying the plurality of microbial species for transcriptionally active genes under metabolically relevant environmental conditions occurs under greenhouse or lab based conditions and comprises measuring the transcriptomic activity of promoter sequences.

74. The guided microbial remodeling method according to embodiment 51, wherein assaying the plurality of microbial species for transcriptionally active genes under metabolically relevant environmental conditions occurs under greenhouse or lab based conditions and comprises measuring the transcriptomic activity of promoter sequences in the presence of exogenous nitrogen.

75. The guided microbial remodeling method according to embodiment 51, wherein assaying the plurality of microbial species for transcriptionally active genes under metabolically relevant environmental conditions occurs under greenhouse or lab based conditions and comprises measuring the transcriptomic activity of promoter sequences in the presence of exogenous nitrogen, wherein said transcriptomic activity of the promoter sequences is measured by quantifying the expression of a regulated gene.

76. The guided microbial remodeling method according to embodiment 51, wherein assaying the plurality of microbial species for transcriptionally active genes under metabolically relevant environmental conditions occurs under field conditions.

77. The guided microbial remodeling method according to embodiment 51, wherein assaying the plurality of microbial species for transcriptionally active genes under metabolically relevant environmental conditions occurs under field conditions and comprises measuring the transcriptomic profile of the microbial species.

78. The guided microbial remodeling method according to embodiment 51, wherein assaying the plurality of microbial species for transcriptionally active genes under metabolically relevant environmental conditions occurs under field conditions and comprises measuring the transcriptomic activity of genes associated with the microbial species ability to perform a plant-beneficial function of interest.

79. The guided microbial remodeling method according to embodiment 51, wherein assaying the plurality of microbial species for transcriptionally active genes under metabolically relevant environmental conditions occurs under field conditions and comprises measuring the transcriptomic activity of regulatory gene sequences.

80. The guided microbial remodeling method according to embodiment 51, wherein assaying the plurality of microbial species for transcriptionally active genes under metabolically relevant environmental conditions occurs under field conditions and comprises measuring the transcriptomic activity of promoter sequences.

81. The guided microbial remodeling method according to embodiment 51, wherein assaying the plurality of microbial species for transcriptionally active genes under metabolically relevant environmental conditions occurs under field conditions and comprises measuring the transcriptomic activity of promoter sequences in the presence of exogenous nitrogen.

82. The guided microbial remodeling method according to embodiment 51, wherein assaying the plurality of microbial species for transcriptionally active genes under metabolically relevant environmental conditions occurs under field conditions and comprises measuring the transcriptomic activity of promoter sequences in the presence of exogenous nitrogen, wherein said transcriptomic activity of the promoter sequences is measured by quantifying the expression of a regulated gene.

83. The guided microbial remodeling method according to embodiment 51, wherein assaying the plurality of microbial species for transcriptionally active genes under metabolically relevant environmental conditions occurs in vitro.

84. The guided microbial remodeling method according to embodiment 51, wherein assaying the plurality of microbial species for transcriptionally active genes under metabolically relevant environmental conditions occurs in vitro and comprises measuring the transcriptomic profile of the microbial species.

85. The guided microbial remodeling method according to embodiment 51, wherein assaying the plurality of microbial species for transcriptionally active genes under metabolically relevant environmental conditions occurs in vitro and comprises measuring the transcriptomic activity of genes associated with the microbial species ability to perform a plant-beneficial function of interest.

86. The guided microbial remodeling method according to embodiment 51, wherein assaying the plurality of microbial species for transcriptionally active genes under metabolically relevant environmental conditions occurs in vitro and comprises measuring the transcriptomic activity of regulatory gene sequences.

87. The guided microbial remodeling method according to embodiment 51, wherein assaying the plurality of microbial species for transcriptionally active genes under metabolically relevant environmental conditions occurs in vitro and comprises measuring the transcriptomic activity of promoter sequences.

88. The guided microbial remodeling method according to embodiment 51, wherein assaying the plurality of microbial species for transcriptionally active genes under metabolically relevant environmental conditions occurs in vitro and comprises measuring the transcriptomic activity of promoter sequences in N-depleted and N-replete conditions.

89. The guided microbial remodeling method according to embodiment 51, wherein assaying the plurality of microbial species for transcriptionally active genes under metabolically relevant environmental conditions occurs in vitro and comprises measuring the transcriptomic activity of promoter sequences in N-depleted and N-replete conditions, wherein said transcriptomic activity of the promoter sequences is measured by quantifying the expression of a regulated gene.

90. The guided microbial remodeling method according to embodiment 50, wherein assaying the plurality of microbial species for colonization metrics, comprises: growing said plurality of microbial species in intimate association with a target plant.

91. The guided microbial remodeling method according to embodiment 50, wherein assaying the plurality of microbial species for colonization metrics, comprises: growing said plurality of microbial species in intimate association with a target plant under greenhouse or lab based conditions.

92. The guided microbial remodeling method according to embodiment 50, wherein assaying the plurality of microbial species for colonization metrics, comprises: growing said plurality of microbial species in intimate association with a target plant under field conditions.

93. The guided microbial remodeling method according to embodiment 51, wherein assaying the plurality of microbial species for transcriptionally active genes under metabolically relevant environmental conditions, comprises: growing said plurality of microbial species in intimate association with a target plant.

94. The guided microbial remodeling method according to embodiment 51, wherein assaying the plurality of microbial species for transcriptionally active genes under metabolically relevant environmental conditions, comprises: growing said plurality of microbial species in intimate association with a target plant under greenhouse or lab based conditions.

95. The guided microbial remodeling method according to embodiment 51, wherein assaying the plurality of microbial species for transcriptionally active genes under metabolically relevant environmental conditions, comprises: growing said plurality of microbial species in intimate association with a target plant under field conditions.

96. The guided microbial remodeling method according to embodiment 51, wherein assaying the plurality of microbial species for colonization metrics and transcriptionally active genes under metabolically relevant environmental conditions, comprises: growing said plurality of microbial species in intimate association with a target plant under field conditions.

97. The guided microbial remodeling method according to embodiment 50, wherein step b) comprises assaying the plurality of microbial species for ability to perform a plant-beneficial function of interest under greenhouse or lab based conditions.

98. The guided microbial remodeling method according to embodiment 50, wherein step b) comprises assaying the plurality of microbial species for nitrogen fixation activity.

99. The guided microbial remodeling method according to embodiment 50, wherein step b) comprises assaying the plurality of microbial species for nitrogen fixation activity in an acetylene reduction assay or ammonium excretion assay.

100. The guided microbial remodeling method according to embodiment 50, wherein the transformation plasmid is a suicide plasmid.

101. The guided microbial remodeling method according to embodiment 54, wherein the sequencing comprises whole genome sequencing.

102. A guided microbial remodeling method for the rational improvement of plant-associated microbes to perform plant-beneficial functions, comprising:

a. providing a plurality of microbial species;

b. assaying the plurality of microbial species for: colonization metrics, and ability to perform a plant-beneficial function of interest;

c. selecting a candidate microbial species from the plurality of assayed microbial species;

d. introducing one or more targeted non-intergeneric genetic variations into the candidate microbial species at a target genomic locus in one or more genomic pathways, or sets of genes, that are associated with a plant-beneficial function of interest;

e. confirming integration of the non-intergeneric genetic variation at the target genomic locus and absence of any transgenic genetic sequence; and f. repeating steps d)-e) one or more times, until a candidate microbial species has acquired an improved ability to perform the plant-beneficial function of interest.

103. The guided microbial remodeling method according to embodiment 102, wherein the step b) comprises assaying transcriptionally active genes under metabolically relevant environmental conditions.

104. The guided microbial remodeling method according to embodiment 102, wherein in step d), said non-intergeneric genetic variations are selected from the group consisting of: full gene deletions, partial gene deletions, promoter insertions, single base pair changes, and combinations thereof.

105. The guided microbial remodeling method according to embodiment 102, wherein step e) comprises sequencing the genome of the candidate microbial species.

106. A guided microbial remodeling method for the rational improvement of plant-associated microbes to perform plant-beneficial functions, comprising:

a. providing a plurality of microbial species;

b. assaying the plurality of microbial species for: colonization metrics, and ability to perform a plant-beneficial function of interest;

c. selecting a candidate microbial species from the plurality of assayed microbial species;

d. introducing two or more targeted non-intergeneric genetic variations into the candidate microbial species at two or more target genomic loci, in one or more genomic pathways, or sets of genes, that are associated with a plant-beneficial function of interest; and e. confirming introduction of the non-intergeneric genetic variations at the target genomic loci and absence of any transgenic genetic sequence.

107. The guided microbial remodeling method according to embodiment 106, wherein step b) comprises assaying transcriptionally active genes under metabolically relevant environmental conditions.

108. The guided microbial remodeling method according to embodiment 106, wherein in step d), said non-intergeneric genetic variations are selected from the group consisting of: full gene deletions, partial gene deletions, promoter insertions, single base pair changes, and combinations thereof.

109. The guided microbial remodeling method according to embodiment 106, wherein step e) comprises sequencing the genome of the candidate microbial species.

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following Claims define the scope of the disclosure and that methods and structures within the scope of these claims and their equivalents be covered thereby.

INCORPORATION BY REFERENCE

All references, articles, publications, patents, patent publications, and patent applications cited herein are incorporated by reference in their entireties for all purposes. However, mention of any reference, article, publication, patent, patent publication, and patent application cited herein is not, and should not be taken as, an acknowledgment or any form of suggestion that they constitute valid prior art or form part of the common general knowledge in any country in the world. Further, U.S. Pat. No. 9,975,817, issued on May 22, 2018, and entitled: Methods and Compositions for Improving Plant Traits, is hereby incorporated by reference. Further, PCT/US2018/013671, filed Jan. 12, 2018, and entitled: Methods and Compositions for Improving Plant Traits, is hereby incorporated by reference.

SEQUENCE LISTING (434 sequences)

SEQ ID NO: 1 - protein, 9 aa, unidentified
  REGION 1..9: note = "LAGLIDADG" family peptide motif sequence
LAGLIDADG

SEQ ID NO: 2 - DNA, 90 bp, synthetic construct
  misc_feature 1..90: note = Synthetic oligonucleotide
  source 1..90: mol_type = other DNA
gttgatcagaccgatgttcggaccttccaaggtttcgatcggacatacgcgaccgtagtgggtcgggtgtacgtctcgaacttcaaagcc

SEQ ID NO: 3 - DNA, 257 bp, synthetic construct
  misc_feature 1..257: note = Synthetic polynucleotide
  source 1..257: mol_type = other DNA
gcctctcggggcgcttttttttattccggcactagccgctattaataaaaatgcaaatcggaatttactatttaacgcgagattatctaagatgaatccgatggaagcgcgctgttttcactcgcctttttaaagttacgtgatgatttcgatgcttctttgagcgaacgatcaaaaataagcgtattcaggtaaaaaaatattctcatcacaaaaaagtttgtgtaatacttgtaacgctacatggagattaactc

SEQ ID NO: 4 - DNA, 260 bp, synthetic construct
  misc_feature 1..260: note = Synthetic polynucleotide
  source 1..260: mol_type = other DNA
ggttcacataaacataattatcgccacggcgatagccgtacgctttttgcgtcacaacatccatggtgaagccggctttttcaagaacacgcgccacctcatcgggtcttaaatacatactcattcctcattatcttttaccgcacgttaaccttaccttattcattaaaggcaacgctttcggaatattccataaagggctatttacagcataattcaaaatcttgtcctacacttatagactcaatggaattaaggga

SEQ ID NO: 5 - DNA, 260 bp, synthetic construct
  misc_feature 1..260: note = Synthetic polynucleotide
  source 1..260: mol_type = other DNA
gcgcggaaaatcgacgcatagcgcattctcagaagccggcctggtctcggtggaaaagcgaatctttcccacgaccgccgggcctttaacaaaagaatcaatgacctgattaatgtcgctatccattctctctccgcgtaatgcgatcttttttcatcatacctaacaaactggcagagggaaaagccgcgcggtttttctgcgaagtgtattgtaagatttgtttgatatgttatatcgtaacatattattgcaaacat

SEQ ID NO: 6 - DNA, 259 bp, synthetic construct
  misc_feature 1..259: note = Synthetic polynucleotide
  source 1..259: mol_type = other DNA
ctgacgaagcgagttacatcaccggtgaaactctgcacgtcaacggcggaatgtatatggtctgaccgagatttgcgcaaaacgctcaggaaccgcgcagtctgtgcggttcactgtaatgttttgtacaaaatgatttgcgttatgagggcaaacagccgcaaaatagcgtaaaatcgtggtaagacctgccgggatttagttgcaaatttttcaacattttatacactacgaaaaccatcgcgaaagcgagttttga

SEQ ID NO: 7 - DNA, 260 bp, synthetic construct
  misc_feature 1..260: note = Synthetic polynucleotide
  source 1..260: mol_type = other DNA
acgcctggggcgccgaccagcgggaagagtgatttggccaacgaggcgccgctctgaatggaaatcatggcgattaaaataaccagtatcggcaaccatgccggtaccttacgagacgagccgggcatcctttctcctgtcaattttgtcaaatgcggtaaaggttccagtgtaattgaattaccccgcgccggttgagctaatgttgaaaaaaagggtcttaaaagcagtacaatagggcgggtctgaagataatttca

SEQ ID NO: 8 - DNA, 260 bp, synthetic construct
  misc_feature 1..260: note = Synthetic polynucleotide
  source 1..260: mol_type = other DNA
tctgattcctgatgaaaataaacgcgaccttgaagaaattccggataacgttatcgccgatttagatatccatccggtgaaacgaatcgaggaagttctggcacttgcgctacagaacgaaccgtttggaatggaagtcgtcacggcaaaatagtgatttcgcgcaaatagcgctaagaaaaatagggctggtaagtaaattcgtacttgccagcctttttttgtgtagctaacttagatcgctggcaggggggtcaatt

SEQ ID NO: 9 - DNA, 259 bp, synthetic construct
  misc_feature 1..259: note = Synthetic polynucleotide
  source 1..259: mol_type = other DNA
gtaagaaagtcggcctgcgtaaagcacgtcgtcgtcctcagttctccaaacgttaattgttttctgctcacgcagaacaatttgcgaaaaaacccgcttcggcgggtttttttatggataaatttgccattttccctctacaaacgccccattgttaccactttttcagcatttccagaatcccctcaccacaacgtcttcaaaatctggtaaactatcatccaattttctgcccaaatgcaggtgattgttcattttt

SEQ ID NO: 10 - DNA, 260 bp, synthetic construct
  misc_feature 1..260: note = Synthetic polynucleotide
  source 1..260: mol_type = other DNA
gtcaaagccgtattatcgaccccttagggacaacgcttgccggggcgggagagcggccgcagttgatttttgccgaactttcagctgattatattcagcaggtacgcgagcgcctgccggtgttgcgcaatcgccgctttgcgccaccgcaattattatgacgtttttttaaacaaggcttgattcaccttgttacagattgctattgtgtccgcgcgtcaaatagccgttaattgtatgcgtgtatgatggcgtattcg

SEQ ID NO: 11 - DNA, 260 bp, synthetic construct
  misc_feature 1..260: note = Synthetic polynucleotide
  source 1..260: mol_type = other DNA
gaggcggtggttgaccgtatcggtcccgagcatcatgagctttcggggcgagcgaaagatatgggatcggcggcggtactgctggcgattatcatcgcgctgatcgcgtggggaacgctgctgtgggcgaactaccgctaagtcttgtcgtagctgctcgcaaaacggaaagaaactcctgatttttgtgtgaaatgtggttccaaaatcaccgttagctgtatatactcacagcataactgtatatacacccagggggc

SEQ ID NO: 12 - DNA, 260 bp, synthetic construct
  misc_feature 1..260: note = Synthetic polynucleotide
  source 1..260: mol_type = other DNA
taagaaaagcggcctgtacgaagacggcgtacgtaaagacaggctggataacgacgatatgatcgatcagctggaagcgcgtattcgcgctaaagcatcgatgctggatgaggcgcgtcgtatcgatatccagcaggttgaagcgaaataacgtgttgggaagcgatacgcttcccgtgtatgattgaacctgcgggcgcgaggcgccggggttcatttttgtatatataaagagaataaacgtggcaaagaacattcaa

SEQ ID NO: 13 - DNA, 237 bp, synthetic construct
  misc_feature 1..237: note = Synthetic polynucleotide
  source 1..237: mol_type = other DNA
atgaatcgtactaaactggtactgggcgcggtaatcctgggttctactctgctggctggttgctccagcaatgctaaaatcgatcagctgtcttctgacgttcagactctgaacgctaaagttgaccagctgagcaacgacgtgaacgcaatgcgttccgacgttcaggctgctaaagatgacgcagctcgcgctaaccagcgtctggacaacgcagctactaaataccgtaagtaa

SEQ ID NO: 14 - DNA, 327 bp, synthetic construct
  misc_feature 1..327: note = Synthetic polynucleotide
  source 1..327: mol_type = other DNA
atggccaaccgagcaaaccgcaacaacgtagaagagagcgctgaagatatccataacgatgtcagccaattagcggatacgctggaagaggtgctgaaatcgtggggcagcgacgccaaagacgaagcggaggccgcgcgcaaaaaagcgcaggcgctgctgaaagagacccgcgcccggcttaacggcaacaaccgcgtccagcaggcggcgtgcgacgccatgggctgcgctgacagctacgtgcgcgacaaaccgtggcaaagcgtcggcgccgcagcagccgttggggtatttattggcgtattactgaatttacgtcgataa

SEQ ID NO: 15 - DNA, 648 bp, synthetic construct
  misc_feature 1..648: note = Synthetic polynucleotide
  source 1..648: mol_type = other DNA
atgaccaaaaagatttccgccctagcgtttggcattggcatggtaatggcgagcagccaggcttttgcccacggtcaccatagtcatggcccggcgctgaccgaagcggaacaaaaggcgagtgaaggcatttttgctgaccaggacgtaaaggacagggcgctgagcgactgggaggggatctggcagtcggttaacccctatctgctgaacggggatttagatccggttctggagcagaaggccaaaaaggccggtaaaagcgtggcggaatatcgggaatattataagaagggctacgctaccgatgtcgaccagattggtatcgaggataacgtcatggagtttcacgtcgggaaaaccgtcaacgcctgtaagtacagctattccggttacaaaattctgacctacgcatccggtaaaaaaggcgtgcgctacctgttcgaatgccagcaggcggattcaaaagcgccgaagtttgttcagtttagcgatcacaccatcgcgccacgcaagtcccagcatttccacatctttatgggcaatgagtcccaggaagcgctgctgaaagagatggataactggccaacctactatccttatgcgctgcataaagagcagattgtcgacgaaatgctgcaccactaa

SEQ ID NO: 16 - DNA, 237 bp, synthetic construct
  misc_feature 1..237: note = Synthetic polynucleotide
  source 1..237: mol_type = other DNA
atgagcactatcgaagaacgcgttaagaaaattatcggcgaacagctgggcgttaagcaggaagaagttaccaacaatgcttccttcgttgaagacctgggcgctgattctcttgacaccgttgagctggtaatggctctggaagaagagtttgatactgagattccggacgaagaagctgagaaaatcactactgttcaggctgccattgattacatcaacggccaccaggcgtaa

SEQ ID NO: 17 - DNA, 513 bp, synthetic construct
  misc_feature 1..513: note = Synthetic polynucleotide
  source 1..513: mol_type = other DNA
atgaataaaattgcacgtttttcagcactggccgttgttctggctgcatccgtaggtaccactgctttcgctgcgacttctaccgttaccggtggctacgcgcagagcgacatgcagggtgaagcgaacaaagctggcggtttcaacctgaagtaccgctacgagcaagacaacaacccgctgggtgttatcggttctttcacctacaccgaaaaagatcgttctgaatctggcgtttacaaaaaaggccagtactacggcatcaccgcaggtccggcttaccgtctgaacgactgggctagcatctacggcgtagtgggtgttggttacggtaaattccaggacaacagctacccgaacaaatctgatatgagcgactacggtttctcttacggcgctggtctgcagttcaacccgatcgaaaacgttgccctggacttctcctacgagcagtctcgcattcgtaacgttgacgttggcacctggattgctggcgtaggttaccgcttctaa

SEQ ID NO: 18 - DNA, 273 bp, synthetic construct
  misc_feature 1..273: note = Synthetic polynucleotide
  source 1..273: mol_type = other DNA
gtgaataaatctcaactgattgacaaaattgctgccggtgcggacatttctaaagccgcagctggacgtgcgttagatgctttaatcgcttctgttactgaatctctgcaggctggagatgacgttgcgctggtagggtttggtacttttgctgttaaagagcgcgctgcccgtactggtcgcaatccgcaaacaggcaaagaaatcaccattgctgctgctaaagttccgggtttccgcgcaggtaaagcgctgaaagacgcggtaaactga

SEQ ID NO: 19 - DNA, 639 bp, synthetic construct
  misc_feature 1..639: note = Synthetic polynucleotide
  source 1..639: mol_type = other DNA
atggctgtcgctgccaacaaacgttcggtaatgacgctgttttctggtcctactgacatctatagccatcaggtccgcatcgtgctggccgaaaaaggtgttagttttgagatagagcacgtggagaaggacaacccgcctcaggatctgattgacctcaacccgaatcaaagcgtaccgacgcttgtggatcgtgagctcactctgtgggaatctcgcatcattatggaatatctggatgagcgtttcccgcatccgccgctcatgccggtttacccggtggcgcgtggggaaagccgtctgtatatgcagcgtatcgaaaaggactggtattcgttgatgaataccattcagaccggtaccgctgcgcaggctgatactgcgcgtaagcagctgcgtgaagaactacaggcgattgcgccagttttcacccagaagccctacttcctgagcgatgagttcagcctggtggactgctacctggcaccactgctgtggcgtctgccggttctcggcgtagagctggtcggcgctggcgcgaaagagcttaaaggctatatgactcgcgtatttgagcgcgactctttcctcgcttctttaactgaagccgaacgtgaaatgcgtctcggtcggggctaa

SEQ ID NO: 20 - DNA, 204 bp, synthetic construct
  misc_feature 1..204: note = Synthetic polynucleotide
  source 1..204: mol_type = other DNA
atgggtgagattagtattaccaaactgctggtagtcgcagcgctgattatcctggtgtttggtaccaaaaagttacgcacgctgggtggagacctgggctcggctatcaaaggctttaaaaaagccatgagcgatgacgatgacagtgcgaagaagaccagtgctgaagaagcgccggcacagaagctctctcataaagagtaa

SEQ ID NO: 21 - DNA, 609 bp, synthetic construct
  misc_feature 1..609: note = Synthetic polynucleotide
  source 1..609: mol_type = other DNA
atgaaagcgttaacgaccaggcagcaagaggtgtttgatctcattcgggatcatatcagccagacgggcatgccgccgacgcgtgcggagattgctcagcgcttggggtttcgctccccaaacgcggcggaagagcatctgaaagcgctggcgcgtaaaggcgcaatcgagatcgtttccggcgcctcccgcggtattcgtctgctgacggaagaagaaaccggtctgccgcttattggccgcgtcgcggcaggtgagccgctgctagcgcagcagcacattgaaggccactaccaggtggacccggccatgtttaagccgaacgccgattttctgctgcgtgttagcggtatgtcgatgaaggatatcggtattctcgatggcgacctgctggctgtccataaaacgcaggatgtgcgcaatggtcaggtggttgtggcgcgtatcgacgaagaagtgaccgtgaagcgtctgaaaaaacagggtaacgtcgtggaattgctgccggaaaacagcgaattctcgccgatcgtggtcgaccttcgcgaacaaagctttactattgaaggcctggccgtcggcgttatccgcaacggcaactggcaataa

SEQ ID NO: 22 - DNA, 1245 bp, synthetic construct
  misc_feature 1..1245: note = Synthetic polynucleotide
  source 1..1245: mol_type = other DNA
atgaacgattatctgccgggcgaaaccgctctctggcagcgcattgaaggctcactgaagcaggtgcttggtagctacggttacagcgaaatccgtttgccgattgtagagcagaccccgttattcaaacgcgctatcggcgaagtgaccgacgtggttgaaaaagagatgtacacctttgaggaccgtaacggcgatagcctgactctacgtccggaaggcacggctggctgcgtacgcgccggtatcgaacatggtctcctgtacaatcaagaacagcgcctgtggtacattgggccgatgttccgccacgaacgtccgcaaaaaggccgctaccgtcagttccaccagattggcgccgaagcgtttggcctgcaggggccggatatcgatgccgagctgattatgctgaccgcccgctggtggcgcgagctgggcatctccggccacgttgcgctggagctgaactctatcggttcgctggaggctcgcgctaactatcgcgacgcgctggtggcctatcttgagcagtttaaagataagctggacgaagactgcaaacgccgcatgtacaccaacccgctgcgcgtgctggattctaaaaacccggacgtccaggcgctgctgaacgacgccccgacgctgggcgactatcttgatgaagagtccaaaacgcattttgccgggctgtgcgcgctgctggatgatgccggtattcgctataccgtgaatcagcgtctggtacgcggtctcgactactacaaccgcaccgtgtttgagtgggtcaccaccagcctcggttcccagggcaccgtctgcgccggaggccgttacgatggtctggttgagcagcttggcggtcgcgctacccctggcgtcggctttgcgatggggctggaacgtcttgttttactggttcaggcagtgaatccggaatttaaagccgatcctgttgtcgatatatacctggtagcctccggaactgacacccagtccgcagcaatgcgtctggctgaacaggtacgcgatgcgttacccggcgttaagctgatgaccaaccatggcggcggcaactttaagaagcagtttgcgcgcgctgataaatggggcgctcgcgttgcgctggtgctgggcgaatcagaaatcgccgacggaaacgtggtagtgaaagatttacgctcaggtgagcaaactaccgtaacgcaggatagcgttgctgcgcatttgcgcacacttctgggttaa

SEQ ID NO: 23 - DNA, 1413 bp, synthetic construct
  misc_feature 1..1413: note = Synthetic polynucleotide
  source 1..1413: mol_type = other DNA
atgaaaaagaccaaaattgtttgcaccatcggtccgaaaaccgaatccgaagagatgttgaccaaaatgctggacgcgggcatgaacgttatgcgtctgaacttctctcacggtgactatgcggaacacggtcagcgcatccagaatctgcgcaatgtgatgagtaaaaccggtaagaaagcggcaatcctgctggacaccaaaggtccggaaatccgtaccattaagctggaaggcggcaacgacgtctccctgaaagcgggccagaccttcaccttcaccaccgataaatccgttgtcggtaataacgaaatcgttgcggtgacctatgaaggcttcaccagcgacctgagcgttggcaacacggtactggttgacgatggtctgatcggtatggaagtgaccgctatcgaaggcaacaaagttgtttgtaaagtgctgaacaacggcgacctcggcgagaacaaaggcgttaacctgccgggcgtatctatcgcgctgccggcgctggctgaaaaagacaaacaggatctgatcttcggttgcgaacagggcgttgactttgttgcggcatcctttatccgtaagcgttctgacgttgttgaaatccgtgagcacctgaaagcccacggcggcgagaagatccagatcatctccaaaatcgaaaaccaggaaggcctgaacaacttcgacgaaatcctcgaagcctctgacggcatcatggtagcccgtggcgacctgggcgttgaaatcccggttgaagaagttatcttcgcgcagaagatgatgatcgagaaatgtatccgcgcgcgtaaagtcgttatcaccgcgacccagatgctggattccatgatcaaaaacccgcgtccgacccgtgcggaagcaggcgacgtggccaacgccatcctcgacggcaccgacgcagttatgctgtccggcgaatccgcgaaaggtaaatacccgctggaagcggtcaccatcatggcgaccatctgcgaacgtaccgaccgcgtcatgaccagccgtcttgagtacaacaacgacaaccgtaagctgcgcatcaccgaagcggtgtgccgcggtgcggtagaaacggctgaaaaactggaagcgccgctgatcgttgtggcaacccagggcggtaaatccgcgcgcgccgtacgtaaatacttcccggatgccactatcctggcgctgaccaccaacgaaaccaccgcgcgtcagctggtgctgagcaaaggcgttgtggcacagctggttgaagatatctcctctaccgatgcgttctacatccagggtaaagaactggcgctgcagagcggtctggcgcgtaaaggcgacgtggttgttatggtttccggcgcgttagtcccgagcggaaccaccaataccgcttccgtgcacgtgctgtaa

SEQ ID NO: 24 - DNA, 351 bp, synthetic construct
  misc_feature 1..351: note = Synthetic polynucleotide
  source 1..351: mol_type = other DNA
atgtatttaagacccgatgaggtggcgcgtgttcttgaaaaagccggcttcaccatggatgttgtgacgcaaaaagcgtacggctatcgccgtggcgataattatgtttatgtgaaccgtgaagctcgtatggggcgtaccgcgttaattattcatccggctttaaaagagcgcagcacaacgcttgcggagcccgcgtcggatatcaaaacctgcgatcattatgagcagttcccgctctatttagcgggggatgctcaacagcattatggtattccacacgggttcagttcgcgaatggcgcttgagcgttttctgagtggcctgtttggcgaaacgcagtatagctga

SEQ ID NO: 25 - DNA, 864 bp, synthetic construct
  misc_feature 1..864: note = Synthetic polynucleotide
  source 1..864: mol_type = other DNA
atggatagcgacattaatcaggtcattgattcttttgttaaaggcccggcggtcgtgggaaagattcgcttttccaccgagaccaggccggcttctgagaatgcgctatgcgtcgattttccgcgcctcgaaatcatgcttgcgggtcagcttcacgatccggcgattaaagccgatcgcgcccagctcatgccgcacgatgtgctgtatattcccgctggcggatggaatgacccgcaatggctggcgccctccactctgctcactatcttatttggtaaacagcagctggaattcgtcctgcgccactgggacggcagcgcgcttaacgtgctggataaacagcaggttccgcgccgcggtccccgggtcggctcttttctgctgcaggcgctgaatgaaatgcagatgcagccgcgggagcagcacacggcccgctttattgtcaccagcctgctcagccactgtgccgatctgctgggcagccaggtacaaacctcatcgcgcagccaggcgctttttgaagcgattcgtaagcatattgacgcccactttgccgacccgttaacccgggagtcggtggcgcaggcgttttacctctcgccaaactatctatcccacctgttccagaaatgcgggccaatgggctttaacgagtatctgaatcacatccgcctggagcaggccagaatgctgttaaaaggccacgatatgaaagtgaaagatatcgcccacgcctgcggtttcgccgacagcaactacttctgccgcctgtttcgcaaaaacaccgaacgctcgccgtcggagtatcgccgtcaatatcacagccagctgacggaaaaaacagccccggcaaaaaactag

SEQ ID NO: 26 - DNA, 735 bp, synthetic construct
  misc_feature 1..735: note = Synthetic polynucleotide
  source 1..735: mol_type = other DNA
atgagttttgaaggaaaaatcgcgctggttaccggtgcaagtcgcgggattggccgcgcaatcgctgaaacgctcgttgcccgtggcgcgaaagttatcgggactgcgaccagcgaaagcggcgcgcaggcgatcagcgattatttaggtgctaacggtaaaggtctgctgctgaatgtgaccgatcctgcatctattgaatctgttctgggaaatattcgcgcagaatttggtgaagttgatatcctggtgaacaatgccgggatcactcgtgataacctgttaatgcgcatgaaagatgatgagtggaacgatattatcgaaaccaacctgtcatctgttttccgtctgtcaaaagcggtaatgcgcgctatgatgaaaaagcgtcatggacgtattatcactatcggttctgtggttggtaccatgggaaatgcgggtcaggccaactacgctgcggcgaaagcgggtctgattggcttcagtaaatcactggctcgcgaagttgcgtcccgcggtattactgtaaacgttgttgctccgggctttattgaaacggacatgacgcgtgcgctgaccgatgagcagcgtgcgggtacgctggcggcagttcctgcggggcgcctcggctctccaaatgaaatcgccagtgcggtggcatttttagcctctgacgaagcgagttacatcaccggtgaaactctgcacgtcaacggcggaatgtatatggtctga

SEQ ID NO: 27 - DNA, 71 bp, synthetic construct
  misc_feature 1..71: note = Synthetic oligonucleotide
  source 1..71: mol_type = other DNA
atgcccggctcgtctcgtaaggtaccggcatggttgccgatactggttattttaatcgccatgatttccat

SEQ ID NO: 28 - DNA, 2355 bp, synthetic construct
  misc_feature 1..2355: note = Synthetic polynucleotide
  source 1..2355: mol_type = other DNA
atgaatcctgagcgttctgaacgcattgaaatccccgtattgccgttgcgcgatgtggtggtttatccgcacatggtcatacccctgtttgtagggcgggaaaaatctatccgttgtctcgaagcagccatggaccatgataaaaaaatcatgctggttgcgcagaaagaagcctcgacggatgagccgggtgtaaacgatcttttcaccgtcgggaccgtggcgtctattttgcaaatgctgaagctaccggacggtactgttaaagtgctggtcgaaggtttgcagcgcgcgcgcatctctgcgctgtctgataatggcgaacatttttcggcgaaggcggaataccttgaatcgccggcgattgacgaacgcgagcaggaagtgctggttcgtaccgctatcagccagtttgaaggctacatcaagctgaacaaaaaaatccctccggaagtgctgacgtcgctgaatagcatcgacgatccggcgcgtctggcggataccatcgctgcgcatatgccgctgaagctggcggacaaacagtccgtgctggagatgtccgacgttaacgagcgtctggaatatctgatggcgatgatggagtcggaaatcgatctgctgcaggtggagaagcgtattcgcaaccgcgtgaaaaagcagatggagaaatctcagcgcgagtactatctgaatgagcaaatgaaagccattcaaaaagagctcggcgagatggacgacgccccggacgagaacgaagcgctgaagcgtaagatcgacgcggcgaaaatgccgaaagaggcaaaagagaaaaccgaagcggaactgcaaaaactgaaaatgatgtccccgatgtcggcggaagcgaccgtcgttcgcggctacatcgactggatggtgcaggtaccgtggaacgctcgcagcaaggttaaaaaagacctgcgtcaggctcaggagatcctcgataccgatcactacggccttgagcgcgtgaaggatcgcattcttgagtacctcgcggtgcagagccgtgttaacaagctcaaagggccgatcctgtgcctggttgggcctccgggggtaggtaaaacctctctcggccaatccatcgccaaagcaactggacgcaaatatgtgcgtatggcgctgggcggcgtgcgtgatgaagcggaaatccgcggtcaccgccgtacctatattggctcaatgccgggcaaactgatccagaaaatggctaaagtgggcgttaaaaacccgctgttcttgctggatgagatcgacaagatgtcttctgacatgcgcggcgatccggcctcggcgctgctggaggtgttggatccggaacagaacgtggcctttaacgaccactatctggaagtggattacgatctcagcgacgtgatgttcgttgcgacctctaactccatgaacatcccggcgccgctgctggatcgtatggaagtgatccgcctctccggctataccgaagatgagaagctaaacatcgccaaacgccatctgctgtcaaaacagattgagcgtaacgcgctcaagaaaggcgagctgacggtggatgacagcgcgattatcggcatcattcgctactacacccgtgaagcaggcgtgcgtggtctggagcgtgaaatctcgaaactgtgccgcaaagcggtgaaacagctgctgctggataagtcgctgaaacacatcgagattaacggcgacaacctgcacgatttccttggcgtgcagcgctacgactatggtcgtgcggatagcgaaaaccgcgtaggtcaggtgaccggactggcgtggacggaagtgggcggcgatctgctgaccattgaaaccgcctgcgttccgggtaaaggcaaactgacctacaccggttcactgggtgaagtcatgcaggaatccatccaggcggcgctgacggtggttcgttcacgtgcggataagctgggtattaactcagacttttacgaaaaacgtgatattcacgttcacgtgccggaaggcgcgacgccgaaggatggtccaagcgccggtatcgcgatgtgcaccgcgctggtttcctgtctgacgggtaatccggtacgcgccgacgtggcgatgaccggtgagattaccctccgtggccaggtattgccgattggtggtctgaaggaaaaactgttggccgcgcatcgcggcggcattaagactgttctgattcctgatgaaaataaacgcgaccttgaagaaattccggataacgttatcgccgatttagatatccatccggtgaaacgaatcgaggaagttctggcacttgcgctacagaacgaaccgtttggaatggaagtcgtcacggcaaaatag

SEQ ID NO: 29 - DNA, 393 bp, synthetic construct
  misc_feature 1..393: note = Synthetic polynucleotide
  source 1..393: mol_type = other DNA
atggctgaaaatcaatactacggcaccggtcgccgcaaaagttccgcagctcgcgttttcatcaaaccgggcaacggtaaaatcgttatcaaccagcgttctctggaacagtacttcggtcgtgaaactgcccgcatggtagttcgtcagccgctggaactggtcgacatggttgagaaattagatctgtacatcaccgttaaaggtggtggtatctctggtcaggctggtgcgatccgtcacggtatcacccgcgctctgatggagtacgacgagtccctgcgtggcgaactgcgtaaagctggtttcgttactcgtgatgctcgtcaggttgaacgtaagaaagtcggcctgcgtaaagcacgtcgtcgtcctcagttctccaaacgttaa

SEQ ID NO: 30 - DNA, 789 bp, synthetic construct
  misc_feature 1..789: note = Synthetic polynucleotide
  source 1..789: mol_type = other DNA
atgtttgttgctgccggacaatttgccgtaacgccggactggacgggaaacgcgcagacctgcgtcagcatgatgcgccaggccgcggagcggggggcgtcgcttctggttctgcctgaggcgttgctggcgcgagacgataacgatgcggatttatcggttaaatccgcccagcagctggatggcggcttcttacagctcttgctggcggagagcgaaaacagcgctttgacgacggtgctgaccctgcatatcccttccggcgaaggtcgagcgacgaatacgctggtggccctgcgtcaggggaagattgtggcgcaatatcagaaactgcatctctatgatgcgttcaatatccaggaatccaggctggtcgatgccgggcggcaaattccgccgctgatcgaagtcgacgggatgcgcgtcgggctgatgacctgctacgatttacgtttccctgagctggcgctgtcgttagcgctcagcggcgcgcagctcatagtgttgcctgccgcgtgggtaaaagggccgctgaaggaacatcactgggcgacgctgctggcggcgcgggcgctggatacaacctgctatattgtcgccgcaggagagtgcgggacgcgtaatatcggtcaaagccgtattatcgaccccttagggacaacgcttgccggggcgggagagcggccgcagttgatttttgccgaactttcagctgattatattcagcaggtacgcgagcgcctgccggtgttgcgcaatcgccgctttgcgccaccgcaattattatga

SEQ ID NO: 31 - DNA, 369 bp, synthetic construct
  misc_feature 1..369: note = Synthetic polynucleotide
  source 1..369: mol_type = other DNA
atggccaataataccactgggttaacccgaattattaaagcggccgggtattcctggaaaggattccgtgcggcgtgggtcaatgaggccgcatttcgtcaggaaggcatcgcggccgttattgccgtggcgatcgcctgctggttggacgtcgatgccatcacgcgggtgctgctcattagctcggtcctgttagtgatgatagttgaaattatcaatagcgcgattgaggcggtggttgaccgtatcggtcccgagcatcatgagctttcggggcgagcgaaagatatgggatcggcggcggtactgctggcgattatcatcgcgctgatcgcgtggggaacgctgctgtgggcgaactaccgctaa

SEQ ID NO: 32 - DNA, 1122 bp, synthetic construct
  misc_feature 1..1122: note = Synthetic polynucleotide
  source 1..1122: mol_type = other DNA
atgcataaccaggctccgattcaacgtagaaaatcaaaacgaatttacgttgggaatgtgccgattggcgatggcgcccccatcgccgtacagtcgatgacaaacacgcgcaccaccgatgtggcggcgacggtaaatcaaattaaagccctcgagcgcgttggcgcggatatcgtgcgcgtttcggtgccgacgatggatgcggcggaagcgttcaaacttatcaaacagcaggttaacgtcccgctggttgccgatatccacttcgattaccgcattgcgctgaaggtagcggaatacggcgttgattgcctgcgtattaacccgggcaatatcggcaacgaagagcgtatccgcatggtggtggactgcgctcgcgataaaaatattcctatccgtatcggggtaaacgccggttctctggaaaaagatctccaggaaaaatacggcgaaccgactccgcaggcgctgctggaatcggcaatgcgccatgttgatcatctcgatcgtctcaacttcgatcagtttaaagtcagcgtaaaagcctccgatgtgttcctcgcggttgaatcctatcgcctgttggcgaaacagatcgatcagcctctgcacctcgggatcaccgaagcgggcggcgcgcgcagcggcgcggtgaagtccgcgatcggcctcggcctgctgctgtctgaagggattggcgatacgctgcgcgtctctctggcggcggatcccgttgaagagatcaaagtgggcttcgatattctcaagtcgctgcgtattcgctctcgcgggatcaactttattgcctgcccgacctgttcacgtcaggagtttgacgttatcggtaccgttaacgcgctggagcagcgcctggaagatatcattacgccgatggatatttcgatcattggctgcgtggtaaacggtcccggcgaggcgctggtttccaccctcggcgtaaccggcggcaataagaaaagcggcctgtacgaagacggcgtacgtaaagacaggctggataacgacgatatgatcgatcagctggaagcgcgtattcgcgctaaagcatcgatgctggatgaggcgcgtcgtatcgatatccagcaggttgaagcgaaataa

SEQ ID NO: 33 - DNA, 876 bp, synthetic construct
  misc_feature 1..876: note = Synthetic polynucleotide
  source 1..876: mol_type = other DNA
atgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaataagcctgcctggttctgcgtttcccgctctttaataccctgaccggaggtgagcaatga

SEQ ID NO: 34 - DNA, 1491 bp, synthetic construct
  misc_feature 1..1491: note = Synthetic polynucleotide
  source 1..1491: mol_type = other DNA
atgagcatcacggcgttatcagcatcatttcctgaggggaatatcgccagccgcttgtcgctgcaacatccttcactgttttataccgtggttgaacaatcttcggtggcgagcgtgttgagtcatcctgactagctgagatgagggctcgccccctcgtcccgacacttccagatcgccatagcgcacagcgcctcgagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactaagcacataattgctcacagccaaactatcaggtcaagtctgcttttattatttttaagcgtgcataataagccctacacaaatggtacccgaccggtggtgaatttaatctcgctgacgtgtagacattcccttatccagacgctgatcgcccatcatcgcggttctttagatctctcggtccgccctgatggcggcaccttgctgacgttacgcctgccggtacagcaggttatcaccggaggcttaaaatga

SEQ ID NO: 35 - DNA, 1021 bp, synthetic construct
  misc_feature 1..1021: note = Synthetic polynucleotide
  source 1..1021: mol_type = other DNA
ctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaataagccttgaccctacgattcccgctatttcattcactgaccggaggttcaaaatga

SEQ ID NO: 36 - DNA, 1071 bp, synthetic construct
  misc_feature 1..1071: note = Synthetic polynucleotide
  source 1..1071: mol_type = other DNA
atgaagatagcaacaatgaaaacaggtctgggagcgttggctcttcttccctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcccgtccgcgcttaaactccaacatggacgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtccgtctcaactggctgacggagtttatgcctctcccgaccatcaagcattttatccgtactcctgatgatgcgtggttactcaccaccgcgattcctgggaaaacagccttccaggtattagaagaatatcctgattcaggtgaaaatattgttgatgcgctggccgtgttcctgcgccggttacattcgattcctgtttgtaattgtccttttaacagcgatcgtgtatttcgtcttgctcaggcgcaatcacgcatgaataacggtttggttgatgcgagtgattttgatgacgagcgtaatggctggcctgttgaacaagtctggaaagaaatgcacaagctcttgccattctcaccggattcagtcgtcactcatggtgatttctcacttgataaccttatttttgacgaggggaaattaataggttgtattgatgttggacgggtcggaatcgcagaccgttaccaggaccttgccattctttggaactgcctcggtgagttttctccttcattacagaaacggctttttcaaaaatatggtattgataatcctgatatgaataaattgcagtttcatttgatgctcgatgagtttttctaataagcctgtgaagggctggacgtaaacagccacggcgaaaacgcctacaacgcctga

SEQ ID NO: 37 - DNA, 1071 bp, synthetic construct
  misc_feature 1..1071: note = Synthetic polynucleotide
  source 1..1071: mol_type = other DNA
atgaccctgaatatgatgctcgataacgccgtacccgaggcgattgccggctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcccgtccgcgcttaaactccaacatggacgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtccgtctcaactggctgacggagtttatgcctctcccgaccatcaagcattttatccgtactcctgatgatgcgtggttactcaccaccgcgattcctgggaaaacagccttccaggtattagaagaatatcctgattcaggtgaaaatattgttgatgcgctggccgtgttcctgcgccggttacattcgattcctgtttgtaattgtccttttaacagcgatcgtgtatttcgtcttgctcaggcgcaatcacgcatgaataacggtttggttgatgcgagtgattttgatgacgagcgtaatggctggcctgttgaacaagtctggaaagaaatgcacaagctcttgccattctcaccggattcagtcgtcactcatggtgatttctcacttgataaccttatttttgacgaggggaaattaataggttgtattgatgttggacgggtcggaatcgcagaccgttaccaggaccttgccattctttggaactgcctcggtgagttttctccttcattacagaaacggctttttcaaaaatatggtattgataatcctgatatgaataaattgcagtttcatttgatgctcgatgagtttttctaataagccttggttctgcgtttcccgctctttaataccctgaccggaggtgagcaatga

SEQ ID NO: 38 - DNA, 426 bp, synthetic construct
  misc_feature 1..426: note = Synthetic polynucleotide
  source 1..426: mol_type = other DNA
atgaccctgaatatgatgatggatgccggcggacatcatcgcgacaaacaatattaataccggcaaccacaccggcaatttacgagactgcgcaggcatcctttctcccgtcaatttctgtcaaataaagtaaaagaggcagtctacttgaattacccccggctggttgagcgtttgttgaaaaaaagtaactgaaaaatccgtagaatagcgccactctgatggttaattaacctattcaattaagaattatctggatgaatgtgccattaaatgcgcagcataatggtgcgttgtgcgggaaaactgcttttttttgaaagggttggtcagtagcggaaacaactcacttcacaccccgaagggggaagttgcctgaccctacgattcccgctatttcattcactgaccggaggttcaaaatga

SEQ ID NO: 39 - DNA, 446 bp, synthetic construct
  misc_feature 1..446: note = Synthetic polynucleotide
  source 1..446: mol_type = other DNA
atgaccctgaatatgatgatggatgccggctcaccacggcgataaccataggttttcggcgtggccacatccatggtgaatcccactttttccagcacgcgcgccacttcatcgggtcttaaatacatagattttcctcgtcatctttccaaagcctcgccaccttacatgactgagcatggaccgtgactcagaaaattccacaaacgaacctgaaaggcgtgattgccgtctggccttaaaaattatggtctaaactaaaatttacatcgaaaacgagggaggatcctatgtttaacaaaccgaatcgccgtgacgtagatgaaggtgttgaggatattaaccacgatgttaaccagctcgaactcacttcacaccccgaagggggaagttgcctgaccctacgattcccgctatttcattcactgaccggaggttcaaaatga

SEQ ID NO: 40 - DNA, 452 bp, synthetic construct
  misc_feature 1..452: note = Synthetic polynucleotide
  source 1..452: mol_type = other DNA
atgaccctgaatatgatgatggatgccggctgacgaggcaggttacatcactggtgaaaccctgcacgtcaatggcggaatgtatatggtttaaccacgatgaaaattatttgcgttattagggcgaaaggcctcaaaatagcgtaaaatcgtggtaagaactgccgggatttagttgcaaatttttcaacattttatacactacgaaaaccatcgcgaaagcgagttttgataggaaatttaagagtatgagcactatcgaagaacgcgttaagaaaattatcggcgaacagctgggcgttaagcaggaagaagttaccaacaatgcttccttcgttgaagacctgggcgctgattctcttgacaccgaactcacttcacaccccgaagggggaagttgcctgaccctacgattcccgctatttcattcactgaccggaggttcaaaatga

SEQ ID NO: 41 - DNA, 461 bp, synthetic construct
  misc_feature 1..461: note = Synthetic polynucleotide
  source 1..461: mol_type = other DNA
atgaccctgaatatgatgatggatgccggccgtcctgtaataataaccggacaattcggactgattaaaaaagcgcccttgtggcgctttttttatattcccgcctccatttaaaataaaaaatccaatcggatttcactatttaaactggccattatctaagatgaatccgatggaagctcgctgttttaacacgcgttttttaaccttttattgaaagtcggtgcttctttgagcgaacgatcaaatttaagtggattcccatcaaaaaaatattctcaacctaaaaaagtttgtgtaatacttgtaacgctacatggagattaactcaatctagagggtattaataatgaatcgtactaaactggtactgggcgcaactcacttcacaccccgaagggggaagttgcctgaccctacgattcccgctatttcattcactgaccggaggttcaaaatga

SEQ ID NO: 42 - DNA, 463 bp, synthetic construct
  misc_feature 1..463: note = Synthetic polynucleotide
  source 1..463: mol_type = other DNA
atgaccctgaatatgatgatggatgccggcatattgacaccatgacgcgcgtaatgctgattggttctgtgacgctggtaatgattgtcgaaattctgaacagtgccatcgaagccgtagtagaccgtattggtgcagaattccatgaactttccgggcgggcgaaggatatggggtcggcggcggtgctgatgtccatcctgctggcgatgtttacctggatcgcattactctggtcacattttcgataacgcttccagaattcgataacgccctggttttttgcttaaatttggttccaaaatcgcctttagctgtatatactcacagcataactgtatatacacccagggggcgggatgaaagcattaacggccaggaactcacttcacaccccgaagggggaagttgcctgaccctacgattcccgctatttcattcactgaccggaggttcaaaatga

SEQ ID NO: 43 - DNA, 428 bp, synthetic construct
  misc_feature 1..428: note = Synthetic polynucleotide
  source 1..428: mol_type = other DNA
atgaccctgaatatgatgatggatgccggcatcatattgcgctccctggttatcatttgttactaaatgaaatgttataatataacaattataaataccacatcgctttcaattcaccagccaaatgagaggagcgccgtctgacatagccagcgctataaaacatagcattatctatatgtttatgattaataactgatttttgcgttttggatttggctgtggcatccttgccgctcttttcgcagcgtctgcgtttttgccctccggtcagggcatttaagggtcagcaatgagtttttacgcaattacgattcttgccttcggcatgtcgatggatgctttaactcacttcacaccccgaagggggaagttgcctgaccctacgattcccgctatttcattcactgaccggaggttcaaaatga

SEQ ID NO: 44 - DNA, 452 bp, synthetic construct
  misc_feature 1..452: note = Synthetic polynucleotide
  source 1..452: mol_type = other DNA
atgaccctgaatatgatgatggatgccggccgcgtcaggttgaacgtaaaaaagtcggtctgcgcaaagcacgtcgtcgtccgcagttctccaaacgttaattggtttctgcttcggcagaacgattggcgaaaaaacccggtgcgaaccgggtttttttatggataaagatcgtgttatccacagcaatccattgattatctcttctttttcagcatttccagaatcccctcaccacaaagcccgcaaaatctggtaaactatcatccaattttctgcccaaatggctgggattgttcattttttgtttgccttacaacgagagtgacagtacgcgcgggtagttaactcaacatctgaccggtcgataactcacttcacaccccgaagggggaagttgcctgaccctacgattcccgctatttcattcactgaccggaggttcaaaatga

SEQ ID NO: 45 - DNA, 410 bp, synthetic construct
  misc_feature 1..410: note = Synthetic polynucleotide
  source 1..410: mol_type = other DNA
atgaccctgaatatgatgatggatgccggccctgtatgaagatggcgtgcgcaaagatcgcctggataacagcgatatgattagccagcttgaagcccgcattcgcgcgaaagcgtcaatgctggacgaagcgcgtcgtatcgatgtgcaacaggtagaaaaataaggttgctgggaagcggcaggcttcccgtgtatgatgaacccgcccggcgcgacccgttgttcgtcgcggccccgagggttcattttttgtattaataaagagaataaacgtggcaaaaaatattcaagccattcgcggcatgaacgattatctgcctggcgaactcacttcacaccccgaagggggaagttgcctgaccctacgattcccgctatttcattcactgaccggaggttcaaaatga

SEQ ID NO: 46 - DNA, 1071 bp, synthetic construct
  misc_feature 1..1071: note = Synthetic polynucleotide
  source 1..1071: mol_type = other DNA
atgaaaaagattgatgcgattattaaacctttcaaactggatgacgtgcgctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcccgtccgcgcttaaactccaacatggacgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtccgtctcaactggctgacggagtttatgcctctcccgaccatcaagcattttatccgtactcctgatgatgcgtggttactcaccaccgcgattcctgggaaaacagccttccaggtattagaagaatatcctgattcaggtgaaaatattgttgatgcgctggccgtgttcctgcgccggttacattcgattcctgtttgtaattgtccttttaacagcgatcgtgtatttcgtcttgctcaggcgcaatcacgcatgaataacggtttggttgatgcgagtgattttgatgacgagcgtaatggctggcctgttgaacaagtctggaaagaaatgcacaagctcttgccattctcaccggattcagtcgtcactcatggtgatttctcacttgataaccttatttttgacgaggggaaattaataggttgtattgatgttggacgggtcggaatcgcagaccgttaccaggaccttgccattctttggaactgcctcggtgagttttctccttcattacagaaacggctttttcaaaaatatggtattgataatcctgatatgaataaattgcagtttcatttgatgctcgatgagtttttctaataagcctcgcgcgtgattcgtatccgcaccggcgaagaagacgacgcggcgatttaa

SEQ ID NO: 47 - DNA, 1295 bp, synthetic construct
  misc_feature 1..1295: note = Synthetic polynucleotide
  source 1..1295: mol_type = other DNA
atgaccatgaacctgatgacggatgtcgtctcagccaccgggatcgccgggttgctttcacgacaacacccgacgctgttttttacactaattgaacaggcccccgtggcgatcacgctgacggataccgctgcccgcattgtctatgccaacccgggcgtgttgagtcatcctgactagctgagatgagggctcgcctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaataagcctgaccggtggtgaatttaatctcgctgacgtgtagacattcatcgatctgcatccacggtccggcggcggtacctgcctgacgctacgtttaccgctcttttatgaactgaccggaggcccaagatga

SEQ ID NO: 48 - DNA, 1491 bp, synthetic construct; identical to SEQ ID NO: 34
  misc_feature 1..1491: note = Synthetic polynucleotide
  source 1..1491: mol_type = other DNA

SEQ ID NO: 49 - DNA, 1021 bp, synthetic construct; identical to SEQ ID NO: 35
  misc_feature 1..1021: note = Synthetic polynucleotide
  source 1..1021: mol_type = other DNA

SEQ ID NO: 50 - DNA, 1071 bp, synthetic construct; identical to SEQ ID NO: 37
  misc_feature 1..1071: note = Synthetic polynucleotide
  source 1..1071: mol_type = other DNA

SEQ ID NO: 51 - DNA, 461 bp, synthetic construct; identical to SEQ ID NO: 41
  misc_feature 1..461: note = Synthetic polynucleotide
  source 1..461: mol_type = other DNA

SEQ ID NO: 52 - DNA, 426 bp, synthetic construct; identical to SEQ ID NO: 38
  misc_feature 1..426: note = Synthetic polynucleotide
  source 1..426: mol_type = other DNA

SEQ ID NO: 53 - DNA, 452 bp, synthetic construct; identical to SEQ ID NO: 40
  misc_feature 1..452: note = Synthetic polynucleotide
  source 1..452: mol_type = other DNA

SEQ ID NO: 54 - DNA, 426 bp, synthetic construct; identical to SEQ ID NO: 38
  misc_feature 1..426: note = Synthetic polynucleotide
  source 1..426: mol_type = other DNA

SEQ ID NO: 55 - DNA, 461 bp, synthetic construct; identical to SEQ ID NO: 41
  misc_feature 1..461: note = Synthetic polynucleotide
  source 1..461: mol_type = other DNA

SEQ ID NO: 56 - DNA, 1491 bp, synthetic construct; identical to SEQ ID NO: 34
  misc_feature 1..1491: note = Synthetic polynucleotide
  source 1..1491: mol_type = other DNA

SEQ ID NO: 57 - DNA, 1491 bp, synthetic construct; identical to SEQ ID NO: 34
  misc_feature 1..1491: note = Synthetic polynucleotide
  source 1..1491: mol_type = other DNA

SEQ ID NO: 58 - DNA, 1021 bp, synthetic construct; identical to SEQ ID NO: 35
  misc_feature 1..1021: note = Synthetic polynucleotide
  source 1..1021: mol_type = other DNA

SEQ ID NO: 59 - DNA, 1491 bp, synthetic construct; identical to SEQ ID NO: 34
  misc_feature 1..1491: note = Synthetic polynucleotide
  source 1..1491: mol_type = other DNA

SEQ ID NO: 60 - DNA, 1491 bp, synthetic construct; identical to SEQ ID NO: 34
  misc_feature 1..1491: note = Synthetic polynucleotide
  source 1..1491: mol_type = other DNA

SEQ ID NO: 61 - DNA, 1563 bp, synthetic construct
  misc_feature 1..1563: note = Synthetic polynucleotide
  source 1..1563: mol_type = other DNA
atgtttaacgatctgattggcgatgatgaaacggattcgccggaagatgcgctttctgagagctggcgcgaattgtggcaggatgcgttgcaggaggaggattccacgcccgtgctggcgcatctctcagaggacgatcgccgccgcgtggtggcgctgattgccgattttcgcaaagagttggataaacgcaccattggcccgcgagggcggcaggtactcgatcacttaatgccgcatctgctcagcgatgtatgctcgcgcgacgatgcgccagtaccgctgtcacgcctgacgccgctgctcaccggaattattacccgcaccacttaccttgagctgctaagtgaatttcccggcgcactgaaacacctcatttccctgtgtgccgcgtcgccgatggttgccagtcagctggcgcgctacccgatcctgcttgatgaattgctcgacccgaatacgctctatcaaccgacggcgatgaatgcctatcgcgatgagctgcgccaatacctgctgcgcgtgccggaagatgatgaagagcaacagcttgaggcgctgcggcagtttaagcaggcgcagttgctgcgcgtggcggcggcggatattgccggtacgttgccagtaatgaaagtgagcgatcacttaacctggctggcggaagcgattattgatgcggtggtgcagcaagcctgggggcagatggtggcgcgttatggccagccaacgcatctgcacgatcgcgaagggcgcggttttgcggtggtcggttatggcaagctgggcggctgggagctgggttacagctccgatctggatctggtattcctgcacgactgcccgatggatgtgatgaccgatggcgagcgtgaaatcgatggtcgccagttctatttgcgtctcgcgcagcgcgtgatgcacctgtttagcacgcgcacgtcgtccggcatcctttatgaagttgatgcgcgtctgcgtccatctggcgctgcggggatgctggtcactactacggaatcgttcgccgattaccagcaaaacgaagcctggacgtgggaacatcaggcgctggcccgtgcgcgcgtggtgtacggcgatccgcaactgaccgccgaatttgacgccattcgccgcgatattctgatgacgcctcgcgacggcgcaacgctgcaaaccgacgtgcgagaaatgcgcgagaaaatgcgtgcccatcttggcaacaagcataaagaccgcttcgatctgaaagccgatgaaggcggtatcaccgacatcgagtttatcgcccaatatctggtgctgcgctttgcccatgacaagccgaaactgacgcgctggtcggataatgtgcgcattctcgaagggctggcgcaaaacggcatcatggaggagcaggaagcgcaggcattgacgctggcgtacaccacattgcgtgatgagctgcaccacctggcgctgcaagagttgccgggacatgtggcgctctcctgttttgtcgccgagcgtgcgcttattaaaaccagctgggacaagtggctggtggaaccgtgcgccccggcgtaa

SEQ ID NO: 62 - DNA, 1536 bp, Kosakonia sacchari
  misc_feature 1..1536: note = source = 16S rDNA - contig 5, strain CI006
  source 1..1536: mol_type = genomic DNA
ttgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaagggagtaaggttaataaccttattcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagtaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 63 - DNA, 1537 bp, Kosakonia sacchari
  gene 1..1537: note = 16S rDNA - contig 8, strain CI006
  variation 450: note = n is a, c, g, or t
  variation 452: note = n is a, c, g, or t
  variation 455: note = n is a, c, g, or t
  variation 473: note = n is a, c, g, or t
  source 1..1537: mol_type = genomic DNA
ttgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggnantanggttaataacctgtgttnattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagtaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 64 - DNA, 1540 bp, unidentified
  misc_feature 1..1540: note = Rahnella sp.
  gene 1..1540: note = 16S rDNA, strain CI019
  variation 70: note = n is a, c, g, or t
  variation 267: note = n is a, c, g, or t
  variation 455: note = n is a, c, g, or t
  variation 458: note = n is a, c, g, or t
  variation 473: note = n is a, c, g, or t
  variation 1135: note = n is a, c, g, or t
  source 1..1540: mol_type = genomic DNA
attgaagagtttgatcatggctcagattgaacgctggcggcaggcctaacacatgcaagtcgagcggcancgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctnacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcancanacttaatacgtgtgntgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtnatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 65 - DNA, 882 bp, Kosakonia sacchari
  gene 1..882: note = nifH, strain CI006
  source 1..882: mol_type = genomic DNA
atgaccatgcgtcaatgcgccatttacggcaaaggtgggatcggcaaatcgaccaccacacagaacctggtcgccgcgctggcggagatgggtaaaaaagtcatgattgtcggctgtgacccgaaagccgattccacgcgtttgatcctgcatgcgaaagcgcagaacaccattatggagatggctgctgaagtcggctccgtggaagacctggagttagaagacgtgctgcaaatcggttacggcggcgtgcgctgcgcagagtccggcggcccggagccaggcgtgggctgtgccggtcgcggggtgatcaccgcgattaacttcctcgaagaagaaggcgcttacgtgccggatctcgattttgttttctacgacgtgctgggcgacgtggtatgcggtggtttcgccatgccgattcgtgaaaacaaagcgcaggagatctacatcgtttgctctggcgaaatgatggcgatgtacgccgccaacaacatctccaaaggcatcgtgaaatacgccaaatccggtaaagtgcgcctcggcgggctgatttgtaactcgcgccagaccgaccgtgaagatgaactgatcattgcgctggcagaaaaactcggcacgcagatgatccactttgttccccgcgacaacattgtgcagcgtgcggaaatccgccgtatgacggttatcgaatatgacccgacctgcaatcaggcgaacgaatatcgcagccttgccagcaaaatcgtcaacaacaccaaaatggtggtgcccaccccctgcaccatggatgaactggaagaactgctgatggagttcggcattatggatgtggaagacaccagcatcattggtaaaaccgccgccgaagaaaacgccgtctga

SEQ ID NO: 66 - DNA, 1449 bp, Kosakonia sacchari
  gene 1..1449: note = NifD, strain CI006
  source 1..1449: mol_type = genomic DNA
atgagcaatgcaacaggcgaacgcaacctggagataatcgagcaggtgctcgaggttttcccggagaagacgcgcaaagaacgcagaaaacacatgatggtgacggacccggagcaggaaagcgtcggtaagtgcatcatctctaaccgcaaatcgcagccaggcgtgatgaccgtgcgcggctgctcgtatgccggttcgaaaggggtggtatttgggccaatcaaggatatggcgcatatctcgcatggcccaatcggctgcggccaatactcccgcgccgggcggcggaactactacaccggcgtcagcggcgtggacagcttcggcacgctcaacttcacctccgattttcaggagcgcgacatcgtgtttggcggcgataaaaagctcgccaaactgattgaagagctggaagagctgttcccgctgaccaaaggcatttcgattcagtcggaatgcccggtcggcctgattggcgatgacattgaggccgtcgcgaacgccagccgcaaagccatcaacaaaccggttattccggtgcgttgcgaaggctttcgcggcgtgtcgcaatccctcggtcaccatattgccaacgatgtgatccgcgactgggtgctggataaccgcgaaggcaaaccgttcgaatccaccccttacgatgtggcgatcatcggcgattacaacatcggcggcgatgcctgggcttcgcgcattttgctcgaagagatgggcttgcgggtggtggcacagtggtctggcgacggtacgctggtggagatggaaaacacgccgttcgtcaaactgaacctggtgcattgttaccgctcaatgaactacatctcgcgccatatggaggagaagcacggtattccgtggatggaatacaacttctttggtccgacgaaaatcgcggaatcgctgcgcaaaatcgccgaccagtttgacgacaccattcgcgccaacgccgaagcggtgatcgccagataccaggcgcaaaacgacgccattatcgccaaatatcgcccgcgtctggaggggcgcaaagtgctgctttatatgggcgggctgcgtccgcgccatgtgattggcgcctatgaagacctgggaatggagatcatcgctgccggttatgagttcggtcataacgatgattacgaccgcaccttgccggatctgaaagagggcacgctgctgtttgatgatgccagcagttatgagctggaggcgttcgtcaacgcgctgaaaccggatctcatcggttccggcatcaaagagaagtacatctttcagaaaatgggcgtgccgtttcgccagatgcactcctgggattactccggcccgtaccacggctatgacggcttcgccatcttcgcccgcgatatggatatgacgctcaacaaccccgcgtggggccagttgaccgcgccgtggctgaaatccgcctga

SEQ ID NO: 67 - DNA, 1563 bp, Kosakonia sacchari
  gene 1..1563: note = nifK, strain CI006
  source 1..1563: mol_type = genomic DNA
atgagccagactgctgagaaaatacagaattgccatcccctgtttgaacaggatgcttaccagacgctgtttgccggtaaacgggcactcgaagaggcgcactcgccggagcgggtgcaggaagtgtttcaatggaccactaccccggaatatgaagcgctgaactttaaacgcgaagcgctgactatcgacccggcaaaagcctgccagccgctgggcgcggtgctctgttcgctggggtttgccaataccctaccgtatgtgcacggttcacagggttgcgtggcctatttccgcacgtactttaaccgccactttaaagaaccggtggcctgcgtgtcggattcaatgacggaagacgcggcggtgttcggcgggaataacaacctcaacaccggcttacaaaacgccagcgcgctgtataaaccggagattatcgccgtctctaccacctgtatggcggaagtgatcggtgatgatttgcaggcctttatcgccaacgccaaaaaagatggttttctcgatgccgccatccccgtgccctacgcgcacacccccagttttatcggcagccatatcaccggctgggataacatgtttgaaggttttgcccggacctttacggcagaccatgaagctcagcccggcaaactttcacgcatcaacctggtgaccgggtttgaaacctatctcggcaatttccgcgtgctgaaacgcatgatggaacaaatggaggtgccggcgagtgtgctctccgatccgtcggaagtgctggatactcccgccaacgggcattaccagatgtacgcgggcgggacgacgcagcaagagatgcgcgaggcgccggatgctatcgacaccctgttgctgcagccctggcaactggtgaaaagcaaaaaagtggtgcaggagatgtggaatcagcccgccaccgaggtttctgttcccgttgggctggcaggaacagacgaactgttgatggcgattagccagttaaccggcaaggccattcccgattcactggcgctggagcgcgggcggctggtcgatatgatgctcgattcccacacctggttgcacggtaaaaaattcggcctgtttggcgatccggattttgtcatgggattgacccgtttcctgctggagctgggctgcgaaccgaccgttatcctctgccacaacggtaacaaacgctggcagaaagcaatgaagaaaatgcttgacgcctcgccgtacggccaggagagcgaagtgtttatcaactgcgatttgtggcatttccgctcgctgatgtttacccgccagccggattttatgattggcaactcgtacggcaagttcattcagcgcgacaccttagccaaaggcgagcagtttgaagttccgctgatccgcctcggttttcccctgttcgaccgccaccatctgcaccgccagaccacctggggctacgagggcgccatgagcattctcactacccttgtgaatgcggtactggagaaagtggacaaagagaccatcaagctcggcaaaaccgactacagcttcgatcttatccgttaa

SEQ ID NO: 68 - DNA, 1488 bp, Kosakonia sacchari
  gene 1..1488: note = nifL, strain CI006
  source 1..1488: mol_type = genomic DNA
atgaccctgaatatgatgatggatgccggcgcgcccgaggcaatcgccggtgcgctttcgcgacaccatcctgggctgttttttaccatcgttgaagaagcgcccgtcgccatttcgctgactgatgccgacgcacgcattgtctatgccaacccggctttctgccgccagaccggctatgaactagaagcgttgttgcagcaaaatccccgcctgcttgcaagtcgccaaaccccacgggaaatctatcaggatatgtggcacaccttgttacaacgccgaccgtggcgcgggcaattgattaaccgccaccgcgacggcagcctgtatctggtcgagatcgatatcaccccggtgattaacccgtttggcgaactggaacactacctggcaatgcagcgcgatatcagcgccagttatgcgctggagcagcggttgcgcaatcacatgacgctgaccgaagcggtgctgaataacattccggcggcggtggttgtagtggatgaacgcgatcatgtggttatggataaccttgcctacaaaacgttctgtgccgactgcggcggaaaagagctcctgagcgaactcaatttttcagcccgaaaagcggagctggcaaacggccaggtcttaccggtggtgctgcgcggtgaggtgcgctggttgtcggtgacctgctgggcgctgccgggcgtcagcgaagaagccagtcgctactttattgataacaggctgacgcgcacgctggtggtgatcaccgacgacacccaacaacgccagcagcaggaacagggccgacttgaccgccttaaacagcagatgaccaacggcaaactactggcagcgatccgcgaagcgcttgacgccgcgctgatccagcttaactgccccatcaatatgctggcggcggcgcgacgtttaaacggcagtgataacaacaatgtggcgctcgacgccgcgtggcgcgaaggtgaagaggcgatggcgcggctgaaacgttgccgcccgtcgctggaactggaaagtgcggccgtctggccgctgcaacccttttttgacgatctgcgcgcgctttatcacacccgctacgagcaggggaaaaatttgcaggtcacgctggattcccatcatctggtgggatttggtcagcgtacgcaactgttagcctgcctgagtctgtggctcgatcgcacgctggatattgccgccgggctgggtgatttcaccgcgcaaacgcagatttacgcccgcgaagaagagggctggctctctttgtatatcactgacaatgtgccgctgatcccgctgcgccacacccactcgccggatgcgcttaacgctccgggaaaaggcatggagctgcgcctgatccagacgctggtggcacaccaccacggcgcaatagaactcacttcacaccccgaagggggaagttgcctgaccctacgattcccgctatttcattcactgaccggaggttcaaaatga

SEQ ID NO: 69 - DNA, 1575 bp, Kosakonia sacchari
  gene 1..1575: note = nifA, strain CI006
  source 1..1575: mol_type = genomic DNA
atgacccagcgaaccgagtcgggtaataccgtctggcgcttcgatttgtcccagcagttcactgcgatgcagcgcataagcgtggtactcagccgggcgaccgaggtcgatcagacgctccagcaagtgctgtgcgtattgcacaatgacgcctttttgcagcacggcatgatctgtctgtacgacagccagcaggcgattttgaatattgaagcgttgcaggaagccgatcagcagttaatccccggcagctcgcaaatccgctatcgtccgggcgaagggctggtcgggacggtgctttcgcagggccaatcattagtgctggcgcgcgttgctgacgatcagcgctttcttgaccggctcgggttgtatgattacaacctgccgtttatcgccgtgccgctgatagggccagatgcgcagactttcggtgtgctgacggcacaacccatggcgcgttacgaagagcgattacccgcctgcacccgctttctggaaacggtcgctaacctggtcgcgcaaaccgtgcgtttgatggcaccaccggcagtgcgcccttccccgcgcgccgccataacacaggccgccagcccgaaatcctgcacggcctcacgcgcatttggttttgaaaatatggtcggtaacagtccggcgatgcgccagaccatggagattatccgtcaggtttcgcgctgggacaccaccgttctggtacgcggcgagagtggcaccggcaaggagctgattgccaacgccatccaccaccattcgccgcgtgccggtgcgccatttgtgaaattcaactgtgcggcgctgccggacacactgctggaaagcgaattgttcggtcacgagaaaggggcatttaccggcgcggtacgccagcgtaaaggccgttttgagctggccgatggcggcacgctgtttcttgacgagatcggcgagagtagcgcctcgtttcaggctaagctgctgcgcattttgcaggaaggcgaaatggaacgcgtcggcggcgacgagacattgcaagtgaatgtgcgcattattgccgcgacgaaccgcaatcttgaagatgaagtccggctggggcactttcgcgaagatctctattatcgcctgaatgtgatgcccatcgccctgccgccactacgcgaacgccaggaggacattgccgagctggcgcactttctggtgcgtaaaatcgcccataaccagagccgtacgctgcgcattagcgagggcgctatccgcctgctgatgagctacaactggcccggtaatgtgcgcgaactggaaaactgccttgagcgctcagcggtgatgtcggagaacggtctgatcgatcgggatgtgattttgtttaatcatcgcgaccagccagccaaaccgccagttatcagcgtctcgcatgatgataactggctcgataacaaccttgacgagcgccagcggctgattgcggcgctggaaaaagcgggatgggtacaagccaaagccgcgcgcttgctggggatgacgccgcgccaggtcgcctatcgtattcagacgatggatataaccctgccaaggctataa

SEQ ID NO: 70 - DNA, 876 bp, unidentified
  misc_feature 1..876: note = Rahnella sp.
  gene 1..876: note = nifH, strain CI019
  source 1..876: mol_type = genomic DNA
atggcaatgcgtcaatgtgcaatctacgggaaagggggtattggtaaatccaccactacccaaaaccttgtagcggctctggccgaaatgaataagaaggtcatgatcgtcggctgtgaccctaaggctgattcaacccgcctcattctgcatgcgaaagcacagaacaccatcatggaaatggccgctgaagtgggctccgtggaagatctggagctggaagatgtgatgcaaatcggctatggcggcgtgcgctgtgcggaatcaggcggccctgagcctggtgtgggttgtgccggacgcggggtgatcaccgccatcaacttcctcgaagaagaaggcgcgtatgtgccggatctggatttcgtgttttacgacgtattgggcgatgtggtctgtggcggtttcgcgatgccaattcgcgaaaacaaagcgcaggaaatctacatcgtatgctccggtgaaatgatggcgatgtatgccgccaacaacatttccaaaggcatcgtgaaatacgcgaaatcgggcaaagttcgcctggccgggctgatctgtaactcccgccagacggatcgcgaagatgaactgatcatcgcgctggctgaaaaacttggcacgcaaatgatccacttcgtgccgcgtgacaacattgtgcaacgcgctgaaatccgccgcatgacggtcatcgaatacgacccgacttgtgcgcaggcagatcagtatcgtgcactggcgaacaaaatcgtcaacaacaccaaaatggtggtgccgacaccggtcaccatggatgagctggaagccctgttaatggaatttggcattatggaagaagaagacctgaccatcgtcggtcgtaccgccgccgaagaggcgtga

SEQ ID NO: 71 - DNA, 1449 bp, unidentified
  misc_feature 1..1449: note = Rahnella sp.
  gene 1..1449: note = nifD, strain CI019
  source 1..1449: mol_type = genomic DNA
atgaccagtgaaacacgcgaacgtaacgaggcattgatccaggaagtgctggagatcttccccgagaaggcgcttaaagatcgtaagaaacacatgatgaccaccgacccggcgatggaatctgtcggcaagtgtattgtctcaaaccgcaaatcacagccgggcgtgatgaccgtgcgaggctgcgcttacgccggttccaaaggcgtggtctttggcccgatcaaagacatggcgcatatctcccacggcccggttggttgcggccagtattctcgtgccggacgccgtaactattacaccggctggagcggcgtgaacagctttggcaccctcaacttcaccagtgattttcaggaacgggacatcgtatttggcggcgataaaaagctcgacaaactgatcgacgaactggagatgttgttcccgctgaccaaaggcatttcggtacagtcggaatgtccggtcggtctgatcggcgatgacatttctgccgtcgccaaagccagcagcgccaaaatcggtaagccggtcgtgccggtacgctgcgaggggttccgcggtgtgtcgcaatcgctcggccatcacattgctaacgatgtcatccgcgactgggtgctggataaccgcgaaggcaatgaatttgaaaccacgccttacgacgtggcgattatcggcgactacaacatcggcggtgacgcctgggcctcacgtattctgctcgaagaaatggggctgcgtgtggtggcgcagtggtccggcgacggcacgctggtggagatggaaaacaccccgaaagtcgcactcaatctggtgcactgctaccgctcgatgaactacatctcccgtcatatggaagaaaaacacggcattccgtggatggaatacaacttctttggcccgaccaaaattgcggaatctctgcgcgaaatcgcggcgcgttttgacgataccatccggaaaaacgccgaagcggtgattgaaaaatatcaggcgcaaacgcaggcggtgatcgacaaataccgtccgcgtctggaaggcaaaaaggtgctgttgtatctcggcggtttacgtccgcgccacatcatcggggcgtatgaagatctgggaatggaaatcatcggtaccggctatgaattcggtcataacgatgattacgaccgcaccttaccgatgctcaaagaaggcacgttgctgttcgatgacctgagcagttatgagctggaagcgttcgttaaagcgctgaaaccggatcttgtcgggtcaggcatcaaagaaaaatacattttccagaaaatgggcgtgccgttccgccagatgcactcctgggattattccggcccttatcacggctacgacggtttcggcatttttgcccgtgacatggacatgacgctgaacaatccgggctggagtcagctgaccgccccctggttgaaatcggcctga

SEQ ID NO: 72 - DNA, 1569 bp, unidentified
  misc_feature 1..1569: note = Rahnella sp.
  gene 1..1569: note = nifK, strain CI019
  source 1..1569: mol_type = genomic DNA
atgagtcaagatcttggcaccccaaaatcctgtttcccgctgttcgagcaggatgaataccagagtatgtttacccacaaacgcgcgctggaagaagcacacggcgaggcgaaagtgcgggaagtgtttgaatggaccaccacgcaggaatatcaggatctgaacttctcgcgtgaagcgctgaccgtcgacccggcgaaagcctgccagccgttaggcgcggtactttgcgcgctgggttttgccaacacgttgccgtatgtccacggttcacaaggctgtgtggcgtatttccgtacctattttaatcgtcatttcaaagagccggtggcctgtgtttccgactcaatgaccgaagatgccgccgtttttggcggaaataacaacatgaatgtcggtctggaaaacgccagcgcgctgtacaagccggaaattattgctgtctccaccacctgtatggcggaagtgatcggtgatgacctgcaggcttttatcgccaacgccaaaaaagacggatttgtggatgccggtatgccaatcccgtatgcccatacaccgagttttctgggcagtcatgtcaccggctgggacaacatgtttgaaggcttcgcccgtacctttaccaccgacgccacgcgggaatatcagccgggcaaacttgccaaactgaacgtggtgaccggttttgaaacttatctcggcaactaccgggttattcaccgcatgatgagccagatgggggtcgaatgcagcgtcttgtccgatccgtctgaagtgctcgacaccccggctgacggccaataccgcatgtatgccggcggcaccacgcaaaccgaaatgcgtgatgcaccggatgccatcgacaccttgctgctgcaaccgtggcaattgcagaaaaccaaaaaagtggtgcagggcgactggaatcagccgggcaccgaagtcagtgtaccgattggcctggcggcgaccgatgccttgctgatgacggtaagcgaactgaccggcaaaccgatagctgacacgctggcgactgaacgtggccgtctggtggacatgatgctcgattcccacacctggctgcatggcaagcgtttcggtctctacggtgacccggattttgtgatgggcatgaccgcattcctgctggaactgggctgtgaaccgaccaccattctcagccataacggcaacaaacgctggcagaaagccatgaagaaaatgctggctgattcgccttacgggcaggacagcgaagtgtatgtgaactgcgatctgtggcatttccgctcgctgatgtttacccgtaaaccggactttatgatcggcaactcttacggaaaattcattcagcgtgacacgctggccaaaggcgaacagttcgaagtgccgctgatccgcatcggttttccgatttttgaccggcaccatttgcaccgtcagaccacctggggatacgaaggggcgatgagcatactgacgcaactggtgaatgcggtacttgaacaactggatcgcgaaaccatgaagctcggcaaaaccgactacaacttcgacctgatccgctaa

SEQ ID NO: 73 - DNA, 1488 bp, unidentified
  misc_feature 1..1488: note = Rahnella sp.
  gene 1..1488: note = nifL, strain CI019
  source 1..1488: mol_type = genomic DNA
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggccagccagcagacgccgaaacatatctatgacgaaatgtggcgcactttgttgcagggcaaatcctggaacggccaactgatcaaccggcgtaataaccgttcgctttatctggcggatgtcactatcacgcctgttttaggcgcggacgggcaggtggagcattacctcggcatgcacaaagatatcagcgagaaatacgcgctggaacagcggttgcgcaaccacatcaccttgttcacggaggtgctgaacaatattcccgccgccgtggtggtggtggatgagcaggacaatgtggtgatggacaatctggcctacaaaaccctttgcgcggactgcggcggcaaagagctgctggctgaaatgggctatccgcaactcaaagagatgctcaacagtggcgaaccggtgccggtttccatgcgcggcaacgtacgctggttttctttcggtcaatggttattgcagggcgttaatgaagaggccagccgcttttttaccggcattaccgcgccgggaaaactgattgttctgaccgactgcaccgatcagcatcaccggcagcagcagggttatcttgaccggcttaagcaaaaactcaccaacggcaaattattggcggccatccgtgagtcgctcgatgccgcgcttatccagctcaacgggccaatcaatatgctggcggctgcgcgtcgtcttaacggcgaagaaggcaacaacatggcgctggaattcgcctggcgcgaaggcgagcaggcggtgagtcgcttacaggcctgccgtccgtcgctggattttgagccgcaggcagaatggccggtcagtgaattctttgacgatctgagcgcgctgtacgacagccattttctcagtgacggtgaattgcgttacgtggtcatgccatctgatctgcacgctgtcgggcaacgaacgcaaatccttaccgcgctgagcttatggattgatcacacgctgtcacaggcgcaggccatgccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 74 - DNA, 1557 bp, unidentified
  misc_feature 1..1557: note = Rahnella sp.
  gene 1..1557: note = nifA, strain CI019
  source 1..1557: mol_type = genomic DNA
atgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtcgccaatctcatcagccagccactgcgttctgccacgcccccggaatcattgcctgctcaaacgccggtccggtgcagtgttccgcgccagtttggtttcgagcagatggtcgggaaaagtcaggcgatgcgccagacgatggacattttacggcaggtttccaaatgggataccacggttctggtgcgtggtgaaagcggcaccggcaaggaacttatcgccaatgccattcattacaactcaccccgtgcggccgcgccatttgtgaaattcaactgcgccgcgctgccggataacctgctggaaagcgaactgttcggtcatgaaaaaggggccttcaccggcgctatccgtacccgtaaaggccgctttgaactggcggacgggggcacgttattcctcgatgaaatcggcgaatcgagcgcgtcgtttcaggccaaattgctgcgcattttgcaggaaggtgaaatggaacgggtcggcggcgataccacgctgaaagttgatgtgcgcattattgctgccaccaaccgtaatcttgaagaggaagtgcgtgccgggaattttcgcgaagacctgtattatcgcctgaacgtgatgccggtttcgctgcctgcactgcgtgaaaggctggatgatatcgccgatctggcgccgtttctggtcaaaaagattgcgctgcgtcaggggcgggaactgcgcatcagcgacggtgcggtgcgtctgctgatgacctacagctggccaggcaacgtgcgtgaactggaaaactgtctcgaacgggcgtcggtaatgaccgatgaagggctgatcgaccgcgacgtgatcctgttcaatcaccatgaatccccggcgctgtccgtcaaacccggcctgccgctcgcgacagatgaaagctggctggatcaggaactcgacgaacgccagcgggtgattgccgcactggagaaaaccggctgggtgcaggccaaagcggcccgactgctgggcatgacaccgcgccagattgcctaccgtatccagattatggacatcaacatgcaccgtatctga

SEQ ID NO: 75 - DNA, 1314 bp, Kosakonia sacchari
  misc_feature 1..1314: note = Prm5 with 500bp flanking regions, strain CI006
  source 1..1314: mol_type = genomic DNA
aaaactaccgccgcaattaatgaacccaacgctactgttgccgggccatgctcttccccggcgcgctgcccggaaaggatatagattgcccagcacgcgccagcaccaagcgcgaacgccgcgccagtgagatcaacatgtgaaacattttcgcccagcggcagcagatacaagaggccaagtaccgccaggatcacccagatgaaatccaccgggcggcgtgaggcaaaaagcgccaccgccagcgggccggtaaattccagcgccaccgcaacgccgagcggtatcgtctggatcgataaatagaacatatagttcatggcgccgagcgacaggccataaaacagcagtggcaggcgttgttcacgggtaaaatgtaaacgccagggcttgaacactacgaccaaaataagggtgccaagtgcgagacgcagcgcggtgacgccgggtgcgccaacaatcggaaacagtgatttcgccagcgacgcgcctccctgaatggacatcatcgcgacaaacaatattaataccggcaaccacaccggcaatttacgagactgcgcaggcatcctttctcccgtcaatttctgtcaaataaagtaaaagaggcagtctacttgaattacccccggctggttgagcgtttgttgaaaaaaagtaactgaaaaatccgtagaatagcgccactctgatggttaattaacctattcaattaagaattatctggatgaatgtgccattaaatgcgcagcataatggtgcgttgtgcgggaaaactgcttttttttgaaagggttggtcagtagcggaaactttctgttacatcaaatggcgctttagaccccaattcccgcaaagagtttcttaactaattttgatatatttaaacgcgtaggacgtaggatttacttgaagcacatttgaggtggattatgaaaaaaattgcatgtctttcagcactggccgcacttctggcggtttctgcaggttccgcagtagcagcaacttcaaccgtaactggcggctacgctcagagcgacgctcagggtattgctaacaaaactaacggtttcaacctgaaatatcgctacgagcaggacaacaacccgctgggtgttatcggttcctttacttacactgaaaaagatcgcaccgaaagcagcgtttataacaaagcgcagtactacggcatcaccgcaggcccggcttaccgcatcaacgactgggcgagcatctacggtgttgtgggtgtaggttacggtaaattccagcagactgtagacaccgctaaagtgtctgacaccagcgactacg

SEQ ID NO: 76 - DNA, 3413 bp, Kosakonia sacchari
  misc_feature 1..3413: note = nifLA operon - upstream intergenic region plus nifL and nifA CDSs, strain CI006
  source 1..3413: mol_type = genomic DNA
aacacacgctcctgttgaaaaagagatcccgccgggaaatgcggtgaacgtgtctgatattgcgaagagtgtgccagttttggtcgcgggcaaaacctgcaccagtttggttattaatgcaccagtctggcgctttttttcgccgagtttctcctcgctaatgcccgccaggcgcggctttggcgctgatagcgcgctgaataccgatctggatcaaggttttgtcgggttatcagccaaaaggtgcactctttgcatggttatacgtgcctgacatgttgtccgggcgacaaacggcctggtggcacaaattgtcagaactacgacacgactaactgaccgcaggagtgtgcgatgaccctgaatatgatgatggatgccggcgcgcccgaggcaatcgccggtgcgctttcgcgacaccatcctgggctgttttttaccatcgttgaagaagcgcccgtcgccatttcgctgactgatgccgacgcacgcattgtctatgccaacccggctttctgccgccagaccggctatgaactagaagcgttgttgcagcaaaatccccgcctgcttgcaagtcgccaaaccccacgggaaatctatcaggatatgtggcacaccttgttacaacgccgaccgtggcgcgggcaattgattaaccgccaccgcgacggcagcctgtatctggtcgagatcgatatcaccccggtgattaacccgtttggcgaactggaacactacctggcaatgcagcgcgatatcagcgccagttatgcgctggagcagcggttgcgcaatcacatgacgctgaccgaagcggtgctgaataacattccggcggcggtggttgtagtggatgaacgcgatcatgtggttatggataaccttgcctacaaaacgttctgtgccgactgcggcggaaaagagctcctgagcgaactcaatttttcagcccgaaaagcggagctggcaaacggccaggtcttaccggtggtgctgcgcggtgaggtgcgctggttgtcggtgacctgctgggcgctgccgggcgtcagcgaagaagccagtcgctactttattgataacaggctgacgcgcacgctggtggtgatcaccgacgacacccaacaacgccagcagcaggaacagggccgacttgaccgccttaaacagcagatgaccaacggcaaactactggcagcgatccgcgaagcgcttgacgccgcgctgatccagcttaactgccccatcaatatgctggcggcggcgcgacgtttaaacggcagtgataacaacaatgtggcgctcgacgccgcgtggcgcgaaggtgaagaggcgatggcgcggctgaaacgttgccgcccgtcgctggaactggaaagtgcggccgtctggccgctgcaacccttttttgacgatctgcgcgcgctttatcacacccgctacgagcaggggaaaaatttgcaggtcacgctggattcccatcatctggtgggatttggtcagcgtacgcaactgttagcctgcctgagtctgtggctcgatcgcacgctggatattgccgccgggctgggtgatttcaccgcgcaaacgcagatttacgcccgcgaagaagagggctggctctctttgtatatcactgacaatgtgccgctgatcccgctgcgccacacccactcgccggatgcgcttaacgctccgggaaaaggcatggagctgcgcctgatccagacgctggtggcacaccaccacggcgcaatagaactcacttcacaccccgaagggggaagttgcctgaccctacgattcccgctatttcattcactgaccggaggttcaaaatgacccagcgaaccgagtcgggtaataccgtctggcgcttcgatttgtcccagcagttcactgcgatgcagcgcataagcgtggtactcagccgggcgaccgaggtcgatcagacgctccagcaagtgctgtgcgtattgcacaatgacgcctttttgcagcacggcatgatctgtctgtacgacagccagcaggcgattttgaatattgaagcgttgcaggaagccgatcagcagttaatccccggcagctcgcaaatccgctatcgtccgggcgaagggctggtcgggacggtgctttcgcagggccaatcattagtgctggcgcgcgttgctgacgatcagcgctttcttgaccggctcgggttgtatgattacaacctgccgtttatcgccgtgccgctgatagggccagatgcgcagactttcggtgtgctgacggcacaacccatggcgcgttacgaagagcgattacccgcctgcacccgctttctggaaacggtcgctaacctggtcgcgcaaaccgtgcgtttgatggcaccaccggcagtgcgcccttccccgcgcgccgccataacacaggccgccagcccgaaatcctgcacggcctcacgcgcatttggttttgaaaatatggtcggtaacagtccggcgatgcgccagaccatggagattatccgtcaggtttcgcgctgggacaccaccgttctggtacgcggcgagagtggcaccggcaaggagctgattgccaacgccatccaccaccattcgccgcgtgccggtgcgccatttgtgaaattcaactgtgcggcgctgccggacacactgctggaaagcgaattgttcggtcacgagaaaggggcatttaccggcgcggtacgccagcgtaaaggccgttttgagctggccgatggcggcacgctgtttcttgacgagatcggcgagagtagcgcctcgtttcaggctaagctgctgcgcattttgcaggaaggcgaaatggaacgcgtcggcggcgacgagacattgcaagtgaatgtgcgcattattgccgcgacgaaccgcaatcttgaagatgaagtccggctggggcactttcgcgaagatctctattatcgcctgaatgtgatgcccatcgccctgccgccactacgcgaacgccaggaggacattgccgagctggcgcactttctggtgcgtaaaatcgcccataaccagagccgtacgctgcgcattagcgagggcgctatccgcctgctgatgagctacaactggcccggtaatgtgcgcgaactggaaaactgccttgagcgctcagcggtgatgtcggagaacggtctgatcgatcgggatgtgattttgtttaatcatcgcgaccagccagccaaaccgccagttatcagcgtctcgcatgatgataactggctcgataacaaccttgacgagcgccagcggctgattgcggcgctggaaaaagcgggatgggtacaagccaaagccgcgcgcttgctggggatgacgccgcgccaggtcgcctatcgtattcagacgatggatataaccctgccaaggctataa

SEQ ID NO: 77 - protein, 495 aa, Kosakonia sacchari
  REGION 1..495: note = misc_feature - NifL, strain CI006
MTLNMMMDAGAPEAIAGALSRHHPGLFFTIVEEAPVAISLTDADARIVYANPAFCRQTGYELEALLQQNPRLLASRQTPREIYQDMWHTLLQRRPWRGQLINRHRDGSLYLVEIDITPVINPFGELEHYLAMQRDISASYALEQRLRNHMTLTEAVLNNIPAAVVVVDERDHVVMDNLAYKTFCADCGGKELLSELNFSARKAELANGQVLPVVLRGEVRWLSVTCWALPGVSEEASRYFIDNRLTRTLVVITDDTQQRQQQEQGRLDRLKQQMTNGKLLAAIREALDAALIQLNCPINMLAAARRLNGSDNNNVALDAAWREGEEAMARLKRCRPSLELESAAVWPLQPFFDDLRALYHTRYEQGKNLQVTLDSHHLVGFGQRTQLLACLSLWLDRTLDIAAGLGDFTAQTQIYAREEEGWLSLYITDNVPLIPLRHTHSPDALNAPGKGMELRLIQTLVAHHHGAIELTSHPEGGSCLTLRFPLFHSLTGGSK

SEQ ID NO: 78 - protein, 524 aa, Kosakonia sacchari
  REGION 1..524: note = NifA, strain CI006
MTQRTESGNTVWRFDLSQQFTAMQRISVVLSRATEVDQTLQQVLCVLHNDAFLQHGMICLYDSQQAILNIEALQEADQQLIPGSSQIRYRPGEGLVGTVLSQGQSLVLARVADDQRFLDRLGLYDYNLPFIAVPLIGPDAQTFGVLTAQPMARYEERLPACTRFLETVANLVAQTVRLMAPPAVRPSPRAAITQAASPKSCTASRAFGFENMVGNSPAMRQTMEIIRQVSRWDTTVLVRGESGTGKELIANAIHHHSPRAGAPFVKFNCAALPDTLLESELFGHEKGAFTGAVRQRKGRFELADGGTLFLDEIGESSASFQAKLLRILQEGEMERVGGDETLQVNVRIIAATNRNLEDEVRLGHFREDLYYRLNVMPIALPPLRERQEDIAELAHFLVRKIAHNQSRTLRISEGAIRLLMSYNWPGNVRELENCLERSAVMSENGLIDRDVILFNHRDQPAKPPVISVSHDDNWLDNNLDERQRLIAALEKAGWVQAKAARLLGMTPRQVAYRIQTMDITLPRL

SEQ ID NO: 79 - DNA, 2850 bp, Kosakonia sacchari
  gene 1..2850: note = glnE, strain CI006
  source 1..2850: mol_type = genomic DNA
atgccgcaccacgcaggattgtcgcagcactggcaaacggtattttctcgtctgccggaatcgctcaccgcgcagccattgagcgcgcaggcgcagtcagtgctcacttttagtgattttgttcaggacagcatcatcgcgcatcctgagtggctggcagagcttgaaagcgcgccgccgcctgcgaacgaatggcaacactatgcgcaatggctgcaagcggcgctggatggcgtcaccgatgaagcctcgctgatgcgcgcgctgcggctgtttcgccgtcgcatcatggtgcgcatcgcctggagccaggcgttacagttggtggcggaagaagatatcctgcaacagcttagcgtgctggcggaaaccctgatcgtcgccgcgcgcgactggctttatgaggcctgctgccgtgagtggggaacgccgagcaatccacaaggcgtggcgcagccgatgctggtactcggcatgggcaaactgggtggcggcgaactcaatttctcatccgatatcgatttgattttcgcctggccggaaaatggcgcaacgcgcggtggacgccgtgagctggataacgcgcaatttttcactcgccttggtcaacggctgattaaagtcctcgaccagccaacgcaggatggctttgtctaccgcgtcgatatgcgcttgcgcccgtttggcgacagcggcccgctggtgctgagctttgccgcgctggaagattactaccaggagcaggggcgcgattgggaacgctacgcgatggtgaaagcgcgcattatgggcgataacgacggcgaccatgcgcgggagttgcgcgcaatgctgcgcccgtttgttttccgccgttatatcgacttcagcgtgattcagtccctgcgtaacatgaaaggcatgattgcccgcgaagtgcgtcgccgtggcctgaaggacaacattaagctcggcgcgggcgggatccgcgaaatagaatttatcgtccaggttttccagctgattcgcggcggtcgcgagcctgcactgcaatcgcgttcactgttgccgacgcttgctgccatagatcaactgcatctgctgccggatggcgacgcaacccggctgcgcgaggcgtatttgtggctgcgacggctggagaacctgctgcaaagcatcaatgacgaacagacacagacgctgccgggcgatgaactgaatcgcgcgcgcctcgcctggggaatgggcaaagatagctgggaagcgctctgcgaaacgctggaagcgcatatgtcggcggtgcgtcagatatttaacgatctgattggcgatgatgaaacggattcgccggaagatgcgctttctgagagctggcgcgaattgtggcaggatgcgttgcaggaggaggattccacgcccgtgctggcgcatctctcagaggacgatcgccgccgcgtggtggcgctgattgccgattttcgcaaagagttggataaacgcaccattggcccgcgagggcggcaggtactcgatcacttaatgccgcatctgctcagcgatgtatgctcgcgcgacgatgcgccagtaccgctgtcacgcctgacgccgctgctcaccggaattattacccgcaccacttaccttgagctgctaagtgaatttcccggcgcactgaaacacctcatttccctgtgtgccgcgtcgccgatggttgccagtcagctggcgcgctacccgatcctgcttgatgaattgctcgacccgaatacgctctatcaaccgacggcgatgaatgcctatcgcgatgagctgcgccaatacctgctgcgcgtgccggaagatgatgaagagcaacagcttgaggcgctgcggcagtttaagcaggcgcagttgctgcgcgtggcggcggcggatattgccggtacgttgccagtaatgaaagtgagcgatcacttaacctggctggcggaagcgattattgatgcggtggtgcagcaagcctgggggcagatggtggcgcgttatggccagccaacgcatctgcacgatcgcgaagggcgcggttttgcggtggtcggttatggcaagctgggcggctgggagctgggttacagctccgatctggatctggtattcctgcacgactgcccgatggatgtgatgaccgatggcgagcgtgaaatcgatggtcgccagttctatttgcgtctcgcgcagcgcgtgatgcacctgtttagcacgcgcacgtcgtccggcatcctttatgaagttgatgcgcgtctgcgtccatctggcgctgcggggatgctggtcactactacggaatcgttcgccgattaccagcaaaacgaagcctggacgtgggaacatcaggcgctggcccgtgcgcgcgtggtgtacggcgatccgcaactgaccgccgaatttgacgccattcgccgcgatattctgatgacgcctcgcgacggcgcaacgctgcaaaccgacgtgcgagaaatgcgcgagaaaatgcgtgcccatcttggcaacaagcataaagaccgcttcgatctgaaagccgatgaaggcggtatcaccgacatcgagtttatcgcccaatatctggtgctgcgctttgcccatgacaagccgaaactgacgcgctggtcggataatgtgcgcattctcgaagggctggcgcaaaacggcatcatggaggagcaggaagcgcaggcattgacgctggcgtacaccacattgcgtgatgagctgcaccacctggcgctgcaagagttgccgggacatgtggcgctctcctgttttgtcgccgagcgtgcgcttattaaaaccagctgggacaagtggctggtggaaccgtgcgccccggcgtaa

SEQ ID NO: 80 - DNA, 1563 bp, Kosakonia sacchari; identical to SEQ ID NO: 61
  gene 1..1563: note = glnE_KO1, strain CI006
  source 1..1563: mol_type = genomic DNA

SEQ ID NO: 81 - protein, 949 aa, Kosakonia sacchari
  REGION 1..949: note = glnE, strain CI006
MPHHAGLSQHWQTVFSRLPESLTAQPLSAQAQSVLTFSDFVQDSIIAHPEWLAELESAPPPANEWQHYAQWLQAALDGVTDEASLMRALRLFRRRIMVRIAWSQALQLVAEEDILQQLSVLAETLIVAARDWLYEACCREWGTPSNPQGVAQPMLVLGMGKLGGGELNFSSDIDLIFAWPENGATRGGRRELDNAQFFTRLGQRLIKVLDQPTQDGFVYRVDMRLRPFGDSGPLVLSFAALEDYYQEQGRDWERYAMVKARIMGDNDGDHARELRAMLRPFVFRRYIDFSVIQSLRNMKGMIAREVRRRGLKDNIKLGAGGIREIEFIVQVFQLIRGGREPALQSRSLLPTLAAIDQLHLLPDGDATRLREAYLWLRRLENLLQSINDEQTQTLPGDELNRARLAWGMGKDSWEALCETLEAHMSAVRQIFNDLIGDDETDSPEDALSESWRELWQDALQEEDSTPVLAHLSEDDRRRVVALIADFRKELDKRTIGPRGRQVLDHLMPHLLSDVCSRDDAPVPLSRLTPLLTGIITRTTYLELLSEFPGALKHLISLCAASPMVASQLARYPILLDELLDPNTLYQPTAMNAYRDELRQYLLRVPEDDEEQQLEALRQFKQAQLLRVAAADIAGTLPVMKVSDHLTWLAEAIIDAVVQQAWGQMVARYGQPTHLHDREGRGFAVVGYGKLGGWELGYSSDLDLVFLHDCPMDVMTDGEREIDGRQFYLRLAQRVMHLFSTRTSSGILYEVDARLRPSGAAGMLVTTTESFADYQQNEAWTWEHQALARARVVYGDPQLTAEFDAIRRDILMTPRDGATLQTDVREMREKMRAHLGNKHKDRFDLKADEGGITDIEFIAQYLVLRFAHDKPKLTRWSDNVRILEGLAQNGIMEEQEAQALTLAYTTLRDELHHLALQELPGHVALSCFVAERALIKTSWDKWLVEPCAPA

SEQ ID NO: 82 - protein, 520 aa, Kosakonia sacchari
  REGION 1..520: note = GlnE_KO1, strain CI006
MFNDLIGDDETDSPEDALSESWRELWQDALQEEDSTPVLAHLSEDDRRRVVALIADFRKELDKRTIGPRGRQVLDHLMPHLLSDVCSRDDAPVPLSRLTPLLTGIITRTTYLELLSEFPGALKHLISLCAASPMVASQLARYPILLDELLDPNTLYQPTAMNAYRDELRQYLLRVPEDDEEQQLEALRQFKQAQLLRVAAADIAGTLPVMKVSDHLTWLAEAIIDAVVQQAWGQMVARYGQPTHLHDREGRGFAVVGYGKLGGWELGYSSDLDLVFLHDCPMDVMTDGEREIDGRQFYLRLAQRVMHLFSTRTSSGILYEVDARLRPSGAAGMLVTTTESFADYQQNEAWTWEHQALARARVVYGDPQLTAEFDAIRRDILMTPRDGATLQTDVREMREKMRAHLGNKHKDRFDLKADEGGITDIEFIAQYLVLRFAHDKPKLTRWSDNVRILEGLAQNGIMEEQEAQALTLAYTTLRDELHHLALQELPGHVALSCFVAERALIKTSWDKWLVEPCAPA

SEQ ID NO: 83 - protein, 341 aa, Kosakonia sacchari
  REGION 1..341: note = GlnE ATase domain, strain CI006
EEQQLEALRQFKQAQLLRVAAADIAGTLPVMKVSDHLTWLAEAIIDAVVQQAWGQMVARYGQPTHLHDREGRGFAVVGYGKLGGWELGYSSDLDLVFLHDCPMDVMTDGEREIDGRQFYLRLAQRVMHLFSTRTSSGILYEVDARLRPSGAAGMLVTTTESFADYQQNEAWTWEHQALARARVVYGDPQLTAEFDAIRRDILMTPRDGATLQTDVREMREKMRAHLGNKHKDRFDLKADEGGITDIEFIAQYLVLRFAHDKPKLTRWSDNVRILEGLAQNGIMEEQEAQALTLAYTTLRDELHHLALQELPGHVALSCFVAERALIKTSWDKWLVEPCAPA

SEQ ID NO: 84 - DNA, 1342 bp, Kosakonia sacchari
  misc_feature 1..1342: note = Prm5 inserted into nifL region, strain CI006, now strain CM029
  source 1..1342: mol_type = genomic DNA
ccgagcgtcggggtgcctaatatcagcaccggatacgagagaaaagtgtctacatcggttcggttgatattgaccggcgcatccgccagcccgcccagtttctggtggatctgtttggcgattttgcgggtcttgccggtgtcggtgccgaaaaaaataccaatatttgccataacacacgctcctgttgaaaaagagatcccgccgggaaatgcggtgaacgtgtctgatattgcgaagagtgtgccagttttggtcgcgggcaaaacctgcaccagtttggttattaatgcaccagtctggcgctttttttcgccgagtttctcctcgctaatgcccgccaggcgcggctttggcgctgatagcgcgctgaataccgatctggatcaaggttttgtcgggttatcagccaaaaggtgcactctttgcatggttatacgtgcctgacatgttgtccgggcgacaaacggcctggtggcacaaattgtcagaactacgacacgactaactgaccgcaggagtgtgcgatgaccctgaatatgatgatggatgccggcggacatcatcgcgacaaacaatattaataccggcaaccacaccggcaatttacgagactgcgcaggcatcctttctcccgtcaatttctgtcaaataaagtaaaagaggcagtctacttgaattacccccggctggttgagcgtttgttgaaaaaaagtaactgaaaaatccgtagaatagcgccactctgatggttaattaacctattcaattaagaattatctggatgaatgtgccattaaatgcgcagcataatggtgcgttgtgcgggaaaactgcttttttttgaaagggttggtcagtagcggaaacaactcacttcacaccccgaagggggaagttgcctgaccctacgattcccgctatttcattcactgaccggaggttcaaaatgacccagcgaaccgagtcgggtaataccgtctggcgcttcgatttgtcccagcagttcactgcgatgcagcgcataagcgtggtactcagccgggcgaccgaggtcgatcagacgctccagcaagtgctgtgcgtattgcacaatgacgcctttttgcagcacggcatgatctgtctgtacgacagccagcaggcgattttgaatattgaagcgttgcaggaagccgatcagcagttaatccccggcagctcgcaaatccgctatcgtccgggcgaagggctggtcgggacggtgctttcgcagggccaatcattagtgctggcgcgcgttgctgacgatcagcgctttcttgaccggctcgggttgtatgattacaacctgccgtttatc

SEQ ID NO: 85 - DNA, 1270 bp, Rahnella aquatilis
  gene 1..1270: note = 16S
  variation 186: note = n is a, c, t, g, unknown or other
  variation 458: note = n is a, c, t, g, unknown or other
  variation 1041: note = n is a, c, t, g, unknown or other
  variation 1131..1132: note = n is a, c, t, g, unknown or other
  variation 1135: note = n is a, c, t, g, unknown or other
  variation 1139..1140: note = n is a, c, t, g, unknown or other
  source 1..1270: mol_type = genomic DNA
attgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgnaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcanacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcgccagagatggcttagtgccttcgggaaccgtganacaggtgctgcatggctgtcgtcagctcgtgttgtgaaatgttgggttaagtcccgcaacgagcgcaacccttatcctttgttgccagcnngtnatgnngggaactcaaaggagactgccggtgataaaccggaggaaggtggggatgacgtcaagtcatcatggcccttacgagtagggctacacacgtgctacaatggcatatacaaagagaagcgaactcgcgagg

SEQ ID NO: 86 - DNA, 876 bp, Rahnella aquatilis
  gene 1..876: note = nifH
  source 1..876: mol_type = genomic DNA
atggcaatgcgtcaatgcgcaatctacgggaaagggggtattgggaaatccaccactacccaaaaccttgtagcggctctggccgaaatgaataagaaggtcatgatcgtcggctgtgaccctaaggctgattcaacccgcctcattctgcatgcgaaagcacagaacaccatcatggaaatggccgctgaagtgggctccgtggaagatctggagctggaagatgtgatgcaaatcggctatggcggcgtgcgctgtgcggaatcaggcggccctgagcctggtgtgggttgtgccggacgcggggtgatcaccgccatcaacttcctcgaagaagaaggcgcgtatgtgccggatctggattttgtgttttacgacgtattgggcgatgtggtctgtggcggtttcgcgatgccaattcgcgaaaacaaagcgcaggaaatctacatcgtgtgctccggtgaaatgatggcgatgtatgccgccaacaacatttccaaaggcatcgtgaaatacgcgaaatcgggcaaagttcgcctggccgggctgatctgtaactcccgccagacggatcgcgaagatgaactgatcatcgcgctggctgaaaaacttggcacgcaaatgatccacttcgtgccgcgtgacaacattgtgcaacgcgctgaaatccgccgcatgacggtcatcgaatacgacccgacttgtgcgcaggcagatcagtatcgtgcactggcgaacaaaatcgtcaacaacaccaaaatggtggtgccgacaccggtcaccatggatgagctggaagccctgttaatggaatttggcattatggaagaagaagacctggccatcgtcggtcgtaccgccgccgaagaggcgtga

SEQ ID NO: 87 - DNA, 1374 bp, Rahnella aquatilis
  gene 1..1374: note = nifD1
  source 1..1374: mol_type = genomic DNA
atgaaggcaaaagagattctggcgctgattgatgagccagcctgtgagcataaccacaagcagaagtcgggttgcagcctgccgaaaccgggcgcgacggcaggcggttgtgcgtttgatggcgcgcagattgcgctgctgccggtcgcggacgtcgcgcatctggtgcacggcccgattggctgtaccggcagttcatgggacaaccgtggcagccgcagttccgggccttccatcaaccgcatgggcttcaccaccgacatgagcgagcaggatgtgattatggggcgcggcgagcgacgcttatttcacgccgtgcagcacatcgtcagccattaccatccggtggcggtctttatttacaacacctgcgtacccgcgatggaaggggatgacgttgaagccgtgtgtcgcgccgcatcggccgctgccggtgtgccggttatttcagtcgatgccgccggtttctacggcagcaaaaatctcggtaaccgcattgccggggacgtgatggtcaaaaaggtgatcggccagcgcgaacccgcgccgtggccggaaaactcaccgatccccgccggacaccgccacagcatcagcctgattggcgaattcaatattgccggcgagttctggcacgttctgccgctgctcgatgagctcgggatccgcgtgctgtgcagcctttccggggattcccgttttgctgaaatccagactatgcaccgtggcgaagccaacatgctggtgtgctcgcgggcgctgatcaacgtcgcccgaaaaatggaagagcgttaccagatcccatggtttgaaggcagtttttatggcctgcgttccatggctgattccctgcgcacgatcgccgtgctgctcaaagacccggatttacaggcgcgcacagaacgtctgattgagcgcgaggaggcggcgacacatcttgcgcttgcgccttaccgtgcgcggctcagcgggcgcaaggcgctgctgtataccggtggcgtgaaatcctggtcggtggtctcggcgttacaggatttaggcatcacggtggtggcgaccggcacccgaaaatcaaccgaagaagacaagcagcgtattcgcgaactgatgggtgaagacgtgctgatgctcgacgaaggcaatgccagaaccttgctcgacaccctctatcgtttcggcggcgacatcatgatcgccgggggccgcaacatgtataccgcgtacaaagcccgcctgccgttcctggatatcaatcaggagcgcgagcatgcgtttgccggatatcacgggctggtaaatctggccgaacagttgtgtatcaccctggaaagcccggtctgggcgcaggtcaaccgtctggcgccgtggcgctaa

SEQ ID NO: 88 - DNA, 1449 bp, Rahnella aquatilis
  gene 1..1449: note = nifD2
  source 1..1449: mol_type = genomic DNA
atgaccagtgaaacacgcgaacgtaacgaggcattgatccaggaagtgctggagatcttccccgagaaggcgcttaaagatcgtaagaaacacatgatgaccaccgacccggcgatggaatctgtcggcaagtgtattgtctcaaaccgcaaatcacagccgggcgtgatgaccgtgcgaggctgcgcttacgccggttccaaaggcgtggtctttggcccgatcaaagacatggcgcatatctcccacggcccggttggttgcggccagtattcccgtgccggacgccgtaactattacaccggctggagcggcgtgaacagctttggcaccctcaacttcaccagtgattttcaggaacgggacatcgtatttggcggcgataaaaagctcgacaaattgatcgatgaactggagatgttgttcccgctgagcaaaggcatttcggtgcagtcggaatgtccggtcggtctgatcggcgatgacatttctgccgtcgccaaagccagcagcgccaaaatcggtaagccggtcgtgccggtacgctgcgaggggttccgcggtgtgtcgcaatcgctcggccatcacattgctaacgatgtcatccgcgactgggtgctggataaccgcgaaggcaatgaatttgaaaccacgccttacgacgtggcgattatcggcgactacaacatcggcggtgacgcctgggcctcacgtattctgctcgaagaaatggggctgcgcgtggtggcgcagtggtccggcgacggcacgctggtggagatggaaaacaccccgaaagtcgcgctcaatctggtgcactgctaccgctcgatgaactacatctcccgtcatatggaagaaaaacacggcattccgtggatggaatacaacttctttggcccgaccaaaattgcggaatctctgcgcgaaatcgcggcgcgttttgacgataccatccggaaaaacgccgaagcggtgattgaaaaatatcaggcgcaaacgcaggcggtgatcgacaaataccgtccgcgtctggaaggcaaaaaggtgctgttgtatctcggcggtttacgtccgcgccacatcatcggggcgtatgaagatctgggaatggaaatcatcggtaccggctatgaattcggtcataacgatgattacgaccgcaccttaccgatgctcaaagaaggcacgttgctgttcgatgacctgagcagttatgagctggaagcgttcgttaaagcgctgaaaccggatcttgtcgggtcaggtatcaaagaaaaatacattttccagaaaatgggcgtgccgttccgccagatgcactcctgggattattccggcccttatcacggctacgacggtttcggcatttttgcccgtgacatggacatgacgctgaacaatccgggctggagtcagctgaccgccccctggttgaaaacggcctga

SEQ ID NO: 89 - DNA, 1386 bp, Rahnella aquatilis
  gene 1..1386: note = nifK1
  source 1..1386: mol_type = genomic DNA
atggctcaaattctgcgtaatgccaagccgcttgccaccacgcctgtcaaaagcgggcaaccgctcggggcgatcctggccagtcaggggctggaaaattgcatcccgctggttcacggcgcgcaaggttgtagcgcgttcgccaaagttttcttcatccagcattttcacgatccgatcccgttgcagtccacggcgatggaatcgaccacgactatcatgggctcggatggcaacgtcagtactgcgttgaccacgttgtgtcagcgcagtaatccaaaagccattgtgattttgagcaccggactgtcagaagcgcagggcagtgatttgtcgatggcgctgcgtgagtttcgcgacaaagaaccgcgctttaatgccatcgctattctgaccgttaacacgccggatttttacggctcgctggaaaacggctacagcgcgctgatggaaagcgtgatcactcagtgggtgccggaaaagccgccgaccggcatgcgtaacaagcgcgtgaacctgctggtgagccatctgctgacgccgggggatctggaattactgcgcagctatgtcgaagcctttggcctgcaaccggtgatcctgccggatttatcacagtcgctggacggacatctggcgaatggcgatttcaatccggtcacgcagggcggcacgtcgcaacgccagattgaacaaatggggcagagcctgaccaccattaccattggcagttcgctcaactgcgccgccagtctgatggcgatgcgcagccgtggcatggcgctgaacctgccgcacctgatgacgctggaaaacatggacagtctgatccgccatctgcatcaggtgtcaggccgcgaggtaccggcatggattgagcgccagcgcgggcaactgctggacgccatgatcgactgccatacctggctgcagtcacagcgtattgcgctggcggcagaagcggatttgctggtggcgtggtgcgatttcgctcagagccagggaatgcgcgtcgggccggtgattgcgccggttaatcagcagtcactggccgggctgccggtcgaacaggtggtgatcggcgatctggaagatttacaaacccggctcgacagctacccggtttcactgctggtggcgaactcccacgctgcaccactggcggaaaaaaacggtatcgcgctggtacgtgccggtttcccgctttacgaccgtctcggggaatttcgccgcgtgcggcagggctatgcgggtattcgcgacaccttgttcgaactcgcgaacctgatgcaggcgcgccatcacatgctgacggcgtatcactcaccgcttaggcaggtgttcggcctgagcccggtaccggaggccagtcatgaggcgcgctaa

SEQ ID NO: 90 - DNA, 1569 bp, Rahnella aquatilis
  gene 1..1569: note = nifK2
  source 1..1569: mol_type = genomic DNA
atgagtcaagatcttggcaccccaaaatcctgtttcccgctgttcgagcaggatgaataccagaatatgtttacccacaaacgcgcgctggaagaagcacacggcgaggcgaaagtgcgggaagtgtttgaatggaccaccacgcaggaatatcaggatctgaacttctcgcgtgaagcgctgaccgtcgacccggcgaaagcctgccagccgttaggcgcggtactttgcgcgctgggttttaccaacacgttgccgtatgtccatggttcacaaggctgtgtggcgtatttccgtacctattttaatcgtcatttcaaagagccggtggcctgtgtttccgactcaatgaccgaagatgccgccgtttttggcggaaataacaacatgaatgtcggtctggaaaacgccagcgcgctgtacaagccggaaattattgcggtctccaccacctgtatggcggaagtgatcggtgatgacctgcaggcttttatcgccaacgccaaaaaagacggatttgtggatgccggtatgccaatcccgtatgcccatacaccgagttttctgggcagtcatgtcaccggctgggacaacatgtttgaaggcttcgcccgtacctttaccaccgacgccacgcgggaatatcagccgggcaaacttgccaaactgaacgtggtgaccggttttgaaacttatctcggcaactaccgggttattcaccgcatgatgagccagatgggggtcgaatgcagcgtcttgtccgatccgtctgaagtgctcgacaccccggctgacggccaataccgcatgtatgccggcggcaccacgcaaaccgaaatgcgtgatgcaccggatgccatcgacaccttgctgctgcaaccgtggcaattacagaaaaccaaaaaggtggtgcagggcgactggaatcagccgggcaccgaagtcagtgtaccgattggcctggcggcgaccgatgccttgctgatgacggtaagcgaactgaccggcaaaccgatagctgacgcgctggcgactgaacgtggccgtctggtggacatgatgctcgattctcacacctggctgcacggcaagcgtttcggtctctacggtgacccggattttgtgatgggcatgaccgcattcctgctggaactgggctgtgaaccgaccaccattctcagccataacggcaacaaacgctggcagaaagccatgaagaaaatgctggctgattcgccttacggacaggacagcgaagtgtatgtgaactgcgatctgtggcatttccgctcgctgatgtttacccgtaaaccggactttatgatcggcaactcttacggaaaattcattcagcgtgacacgctggccaaaggcgaacagttcgaagtgccgctgatccgtatcggattcccgatttttgaccggcaccatttgcaccgtcagaccacctggggatacgagggcgcgatgagcatcctgacgcaactggtgaatgcggtgctcgaacagctggatcgcgaaaccatgaagctcggcaaaaccgactacaacttcgatctgatccgctaa

SEQ ID NO: 91 - DNA, 1488 bp, Rahnella aquatilis
  gene 1..1488: note = nifL
  source 1..1488: mol_type = genomic DNA
atgagcatcacggcgttatcagcatcatttcctgaggggaatatcgccagccgcttgtcgctgcaacatccttcactgttttataccgtggttgaacaatcatcggtggcgatttcgctgaccgatccgcaggcgcgcatttgttatgccaatccggcattctgccgccagacgggttttgcacttgagacacttttgggcgagaaccaccgtctgctggccagccagcagacgccgaaacatatctatgacgaaatgtggcgcactttgttgcagggcaaatcctggaacggccaactgatcaaccggcgtaataaccgttcgctttatctggcggatgtcactatcacgcctgttttaggcgcggacgggcaggtggagcattacctcggcatgcacaaagatatcagcgagaaatacgcgctggagcagcggttgcgcaaccacatcaccttgttcacggaggtgctgaacaatattcccgccgccgtggtggtggtggatgagcaggacaatgtggtgatggacaatctggcctacaaaaccctgtgcgctgactgcggcggaaaagagctgttggccgaaatgggctatccgcaactcaaagagatgctcaacagtggcgaaccggtgccggtttccatgcgcggcaacgtacgctggttttctttcggtcagtggtcattgcagggcgttaatgaagaggccagccgcttttttaccggcattaccgcgccgggaaaactgattgttctcaccgactgcaccgatcagcatcaccggcagcagcagggttatcttgaccggctcaagcaaaaacttaccaacggcaaattgctggcagccatccgcgagtcgcttgatgccgcgctgattcagctcaacgggccaattaatatgctggcggctgcgcgtcgtcttaacggcgaagaaggcaacaacatggcgctggaattcgcctggcgcgaaggcgagcaggcggtgagtcgcttacaggcctgccgtccgtcgctggattttgagccgcaggcagaatggccggtcagtgaattcttcgacgatctgagcgcgctgtacgacagccattttctcagtgacggtgaattgcgttacgtggtcatgccatctgatctgcacgctgtcgggcaacgaacgcaaatccttaccgcgctgagcttatggattgatcacacgctgtcacaggcgcaggccatgccgtctctgaagctctcggtgaacattgttgcgaagcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 92 - DNA, 1557 bp, Rahnella aquatilis
  gene 1..1557: note = nifA
  source 1..1557: mol_type = genomic DNA
atgacccagttacctaccgcgggcccggttatccggcgctttgatatgtctgcccagtttacggcgctttatcgcatcagcgtggcgctgagtcaggaaagcaataccgcgcgcgcactggcggcgatcctcgaagtgcttcacgatcatgcatttatgcaatacggcatggtgtgtctgttcgataaagaacgcaatgcactgtttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgctgattggtgtgccgatccccggtgcggataatcagcctgcgggtgtgctggtggcacagccgatggcgttgcacgaagaccggctggctgccagtacgcggtttttagaaatggtcgccaatctcatcagccagccactgcgttctgccacgcccccggaatcattgcctgctcaaacgccggtccggtgcagtgttccgcgccagtttggttttgagcagatggtcgggaaaagtcaggcgatgcgccagacgatggacattttacggcaggtttccaaatgggataccacggttctggtgcgtggtgaaagcggcaccggcaaggaacttatcgccaatgccattcattacaactcaccccgtgcggccgcgccatttgtgaaattcaactgcgccgcgctgccggataacctgctggaaagcgaactgttcggtcatgaaaaaggggccttcaccggcgctatacgcacccgaaaaggccgctttgaactggcggacgggggcacgttattcctcgatgaaatcggcgaatcgagcgcgtcgtttcaggccaaattgctgcgcattttgcaggaaggtgaaatggaacgggtcggcggcgataccacgctgaaagttgatgtgcgcattattgctgccaccaaccgtaatcttgaggaggaagtgcgtgccgggaattttcgcgaagacctgtattatcgcctgaacgtgatgccggtttcgctgcctgcactgcgtgaaaggctggatgatatcgccgatctggcgccgtttctggtcaaaaagattgcgctgcgtcaggggcgggaactgcgcatcagtgatggtgcggtgcgtctgctgatgacctacagctggccaggcaacgtgcgtgaactggaaaactgcctcgaacgggcgtcggtaatgaccgatgaagggctgatcgaccgcgacgtgatcctgttcaatcaccatgagtccccggcgctgtccgtcaaacccggtctgccgctggcgacagatgaaagctggctggatcaggaactcgacgaacgccagcgggtgattgctgcactggagaaaaccggctgggtgcaggccaaagcggcccgactgctgggcatgacaccgcgccagattgcctaccgtatccagattatggacatcaacatgcaccgtatctga

SEQ ID NO: 93 - DNA, 2838 bp, Rahnella aquatilis
  gene 1..2838: note = glnE
  source 1..2838: mol_type = genomic DNA
atgttgccactttcttctgttttgcaaagccacgcgcagagtttgcctgaacgctggcatgaacatcctgaaaacctgcccctccccgatgatgaacagctggctgtgctgagcagcagtgaattcatgacggacagtttgctggcttttccgcagtggtggcatgaaattgtccaaaatccccctcaggcgcaggagtggcaactttaccgtcagtggctggatgaatcgctgacgcaggtgactgacgaagccgggttaatgaaagctttgcgtctgttccgccgccgtattctgacccgcattgcgtggtcacagtccgcgcaaaccagcgaagcaaaagatacgcttcaccagctgagtgaactggcggaattattgattgtcagcgcccgtgactggctgtatgccgcttgctgtcgcgagttcggtacgccggtcaatgccgcaggggaaccgcagagaatgctgatcctcgggatgggcaaactcggcggtggcgagctgaatttctcatcggacatcgacctgatttttgcttatccggaaaatggccagacacgcggcggtcggcgtgaactggataacgcacaatttttcacccggctcggccagcgtctgatcaaagcgctggatcagcccactatcgacggttttgtctatcgcgtggacatgcgtttgcgtccgttcggcgacagtggcccgctggtgatgagcttcccggcactggaagattattatcaggaacaggggcgcgactgggaacgctacgcaatggtgaaagcgcgtctgatgggcggcgcggaggacatcagcagtcaggaattgcgtaaaatgctgatgccttttgtcttccgccgttatatcgatttcagtgtgatccagtccctgcgtaacatgaaaggcatgatcgcccgcgaagtacgccgccgtggtctgaaagacaacatcaaactcggcgcaggcggtattcgtgaaattgaatttatcgtgcaggtatttcagctgatccgtggcggtcgtgaaccggcattgcagcagcgtgcgttgttgccaacgcttcaggcgctggaaaatctggggctgctgccggtagagcaggtgttgcagttgcgtaacagctatctgttcctgcgacgtctggaaaacctgttgcaggccattgctgacgagcaaacgcaaaccttaccgtccgatgagctgaatcaggcgcgtctggcgtgggggatgaattacgctggctggccgcagcttctggatgcagtgaatgctcacatgcaggccgtacgcgcggtatttaacgatctgattggcgatgacacgccagatgccgaagatgacgtgcaactctcccggttcagcagtttatggattgatacgcttgagcctgacgagctggctccgctggtgccgcaacttgacgaaaatgcgcaacggcatgttttacatcagattgctgattttcgccgtgacgtggataaacgcacgatagggccacgtgggcgtgatcagttggatttgctgatgccgcgtttactggcccaggtctgcacctataaaaatgcggatgtgacgttacagcgcctgatgcagttgctgctcaatatcgtcacgcgcacgacgtatatcgagctgctggtggaatatcccggtgcgctcaaacagttaatacgtctgtgcgctgcctcgccgatggtggcgacgcaacttgcgcgtcatcctttattgctcgacgaactgctcgacccgcgcacgctttaccagccgattgagccgggcgcgtaccgtgatgaactgcggcaatatctgatgcgggtgccaaccgaagacgaagaacaacagcttgaagccgtgcgccagttcaaacaggcacagcatttacgtattgcggccggggatatttccggtgcgttgccggtgatgaaagtcagtgaccatttaacctaccttgcggaggccattctcgacgttgtggtgcaacaggcgtgggaacaaatggtcgtaaaatacggtcagccaacccatcttcagcaccgtaaagggcgcggttttgccgtggtgggttacggaaaactcggtggctgggagctgggttacagctcggatctggatctggtcttcctgctcgattgcgcgccggaagtcatgaccgacggcgaacgcagcattgacgggcgtcagttttatctgcggctggcgcagcgcatcatgcatttattcagcacccgtacgtcgtcaggcattctttatgaggttgacccgcgtctgcggccttccggtgcttccggcatgctggtcagcaccatcgaagcttttgcggattatcaggccaacgaagcctggacatgggagcatcaggcgctggttcgcgcgcgtgtggtttatggtgatccgcaactgacgcagcaatttaatgccacgcgtcgcgacattctttgccgccagcgcgatgccgacggcttgcgtaaggaagtccgtgaaatgcgcgagaaaatgtatgcccatctgggcagcaaaagagccgacgagtttgatctgaaagccgatccgggtggcataacggatattgaattcatcgcacaatatctggttctgcgtttcgcgcatgatgagccgaagctgacccgctggtctgataacgtgcggattttcgaactgatggcgcgacatgacatcatgccggaagaggaagcacgccatctgacgcaggcttacgtgacattgcgcgatgaaattcatcatctggcgttgcaggaacacagcgggaaagtggccgcagacagctttgccactgagcgcgcgcaaatccgcgccagctgggcaaactggcttggctga

SEQ ID NO: 94 - DNA, 1290 bp, Rahnella aquatilis
  gene 1..1290: note = amtB
  source 1..1290: mol_type = genomic DNA
atgaaaaaacttttatccatgatggggcttggtgcagtggctttgctaccttcgcttgccatggcagcagcaccagcagcggcaaacggtgctgataacgcctttatgatgatttgtaccgcgctggtattgttcatgaccgtacccggtgtggcgttgttctacggcggcttactgcgttctaaaaacgttttgtccatgctgactcaggttattgttacctttgctctggtctgcgtcctgtggatcctctacggttacagccttgccttcagtgaaggtaacgcgttcttcggtggtttcagcaacgtaatgatgaaaggcattggcctggattctgtgactggcaccttctcgcagatgatccacgttgcattccagtgttcatttgcctgcatcactgtagcgctgatcgtaggtggtattgctgaacgtgtgcgtttctcagcagttctgattttcactgtgatctggctgactttctcttatattccgatggctcacatggtatgggcaggcggtttcctggctgctgacggtgcgctggactttgccggtggtaccgttgttcatatcaatgccgcaattgctggcctggtaggggcttatctgctgggtaaacgcgccggttttggcaaagaagctttcaaaccacacaacctgccaatggtcttcactggcgcctcaatcctgtatgtgggctggttcggcttcaatgcgggttcagcaagtgccgcaagctctgttgccgcgctggctttcctgaacactgtcattgctactgctggcgcaatcctgtcctggacgctggttgagtggatggtgcgcggtaagccctcactgctgggcgcaagctccggtgctatcgcaggtctggtggctatcacgcctgcatgtggtacggtcggcgtaggtggtgctctgattatcggtctggtaggcggtatcactggtctgtggggggttgttaccctgaaaaaatggctgcgtgttgatgacacctgtgatgtgttcggtgttcatggcgtgtgcggtatcgtaggttgtctgctgacgggtgtattcacgtccagttcacttggcggcgtgggctacgcagaaggcgtgaccatgggccatcaggtttgggtgcagttcttcagcgtgtgcgtaacattggtctggtcaggcgttgttgccttcatcggttacaaagtggctgacatgatcgtaggtctgcgtgttcctgaagaacaagaacgcgaaggtctggacgttaacagccacggcgaaaacgcttacaaccaataa

SEQ ID NO: 95 - DNA, 500 bp, Rahnella aquatilis
  gene 1..500: note = PinfC
  source 1..500: mol_type = genomic DNA
tgaatatcactgactcacaagctacctatgtcgaagaattaactaaaaaactgcaagatgcaggcattcgcgttaaagccgacttgagaaatgagaagattggctttaaaattcgcgaacacacgctacgccgtgttccttatatgttagtttgtggcgataaagaggtcgaagcaggcaaagttgctgttcgtactcgtcgcggcaaagacttaggaagcatggatgttagcgaagtcgttgacaaactgctggcggaaatccgcagcagaagtcatcatcaactggaggaataaagtattaaaggcggaaaacgagttcaaccggcgcgtcctaatcgcattaacaaagagattcgcgcgcaagaagttcgcctcaccggcgtcgatggcgagcagattggtattgtcagtctgaatgaagctcttgaaaaagctgaggaagcgggcgtcgatttagtagaaatcagtccgaatgccgagccgccagtttgtcgaatc

SEQ ID NO: 96 - DNA, 1085 bp, Klebsiella variicola
  gene 1..1085: note = 16S
  source 1..1085: mol_type = genomic DNA
attgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcaccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttggg

SEQ ID NO: 97 - DNA, 882 bp, Klebsiella variicola
  gene 1..882: note = nifH1
  source 1..882: mol_type = genomic DNA
atgaccatgcgtcaatgcgctatctacggtaaaggcggtatcggtaaatccaccaccacccagaatctcgtcgcggccctcgccgagatgggtaagaaagtgatgatcgtcggctgcgatccgaaagcggattccacccgtctgatcctccacgctaaagcccagaacaccatcatggagatggcggcggaagtgggctcggtcgaggatctggagctcgaagacgttctgcaaatcggctatggcgatgtccgttgcgccgaatccggcggcccggagccaggcgtcggctgcgccggacgcggggtgatcaccgccatcaacttcctcgaggaagaaggcgcctatgaagaagatttggatttcgtcttctatgacgtcctcggcgacgtggtctgcggcggcttcgctatgccgatccgcgaaaacaaagcccaggagatctacatcgtctgctccggcgagatgatggcgatgtatgccgccaacaatatctccaaagggatcgtgaagtacgccaaatccggcaaggtgcgcctcggcggcctgatctgtaactcgcgcaaaaccgaccgggaagacgaactgatcatcgccctggcggagaagcttggcacgcagatgatccacttcgttccccgcgacaacattgtgcagcgcgcggagatccgccggatgacggtgatcgagtacgacccgacctgtcagcaggcgaatgaatatcgtcaactggcgcagaagatcgtcaataacaccaaaaaagtggtgccgacgccgtgcaccatggacgagctggaatcgctgctgatggagttcggcatcatggaagaagaagacaccagcatcattggtaaaaccgccgctgaagaaaacgcggcctga

SEQ ID NO: 98 - DNA, 1113 bp, Klebsiella variicola
  gene 1..1113: note = nifH2
  source 1..1113: mol_type = genomic DNA
atggttaggaaaagtagaagtaaaaatacaaatatagaactaactgaacatgaccatttattaataagtcaaataaaaaagcttaaaacacaaaccacttgcttttttaataataaaggaggggttgggaagactacattagtagcaaatttaggagcagagctatcaataaactttagtgcaaaagttcttattgtggatgccgaccctcaatgtaatctcacgcagtatgtattaagtgatgaagaaactcaggacttatatgggcaagaaaatccagatagtatttatacagtaataagaccactatcctttggtaaaggatatgaaagtgacctccctataaggcatgtagagaatttcggttttgacataattgtcggtgaccctagacttgctttacaggaagaccttttagctggagactggcgagatgccaaaggcggtgggatgcgaggaattaggacaacttttgtatttgcagagttaattaagaaagctcgtgagctaaattatgattttgttttctttgacatgggaccatcattaggcgcaatcaacagggcagtattactggcaatggaattctttgtcgtcccaatgtcaatcgatgtattttcactatgggctattaaaaatattggctccacggtttcaatatggaaaaaagaattagacacagggattcggctctcagaggaacctagcgaattatcacaattatcacctcaaggaaaactaaagtttctcggttacgtcacccaacaacataaagaacgctctggatacgatacaattcagcttgagaatactgaggaagaaataaaatcgaaacgtcgggtaaaggcgtatgaagacattggagaggtgtttccttctaaaattactgagcatctttctaaactttatgcatcaaaagatatgaacccacaccttggagatatacgtcatttaggtagtttagctccgaaatcacaatcacaacacgttccgatgatatcagtgtctggtacaggaaattacaccagacttagaaaaagcgcgcgtgaactttatcgagatattgcaagaagatacttagagaacattcagactgctaatggcgagaaatag

SEQ ID NO: 99 - DNA, 1374 bp, Klebsiella variicola
  gene 1..1374: note = nifD1
  source 1..1374: mol_type = genomic DNA
atgaagggaaaggaaattctggcgctgctggacgaacccgcctgcgagcacaaccagaagcaaaaatccggctgcagcgcccctaagcccggcgctaccgccggcggttgcgccttcgacggcgcgcagataacgctcctgcccatcgccgacgtcgcgcacctggtgcacggccccatcggctgcgcgggcagctcgtgggataaccgcggcagcgtcagcgccggcccggccctcaaccggctcggctttaccaccgatcttaacgaacaggatgtgattatgggccgcggcgaacgccgcctgttccacgccgtgcgtcacatcgtcgaccgctatcatccggcggcggtctttatctacaacacctgcgtaccggcgatggagggcgatgacatcgaggcggtctgccaggccgcacagaccgccaccggcgtcccggtcatcgctattgacgccgccggtttctacggcagtaaaaatcttggcaaccgaatggcgggcgacgtgatgctcaggcaggtgattggccagcgcgaaccggccccgtggccagacaacacgccctttgccccggcccagcgccacgatatcggcctgattggcgaattcaatatcgccggcgagttctggcaggtccagccgctgctcgacgagctggggatccgcgtcctcggcagcctctccggcgacggccgctttgccgagatccagaccctgcaccgggcgcaggccaatatgctggtgtgctcgcgcgcgctgatcaacgtcgcccgggggctggagctgcgctacggcacgccgtggtttgaaggcagcttctacgggatccgcgccacctccgacgccttgcgccagctggcgacgctgctgggggatgacgacctgcgccgccgcaccgaggcgctgatcgcccgcgaagagcaggcggcggagcaggctcttgcgccgtggcgtgagcagctccgcgggcgcaaagtgctgctctataccggcggcgtgaaatcctggtcggtggtatcggccctgcaggatctcggcatgaccgtggtggccaccggcacgcgcaaatccaccgaggaggacaaacagcggatccgtgagctgatgggcgacgaggcggtgatgcttgaggagggcaatgcccgcaccctgctcgacgtggtgtaccgctatcaggccgacctgatgatcgccggcggacgcaatatgtacaccgcctggaaagcccggctgccgtttctcgatatcaatcaggagcgcgagcacgcctacgccggctatcagggcatcatcaccctcgcccgccagctctgtctgaccctcgccagccccgtctggccgcaaacgcatacccgcgccccgtggcgctag

SEQ ID NO: 100 - DNA, 1449 bp, Klebsiella variicola
  gene 1..1449: note = nifD2
  source 1..1449: mol_type = genomic DNA
atgaccaacgcaacaggcgaacgtaaccttgcgctcatccaggaagtcctggaggtgtttcccgaaaccgcgcgcaaagagcgcagaaagcacatgatgatcagcgatccgcagatggagagcgtcggcaagtgcattatctcgaaccgtaaatcgcagcccggggtgatgaccgtgcgcggctgcgcctatgcgggctcgaaaggggtggtgtttgggccaatcaaagacatggcccatatctcgcacggccccatcggctgcggccagtattcccgcgccggacggcgcaactactataccggcgtcagcggtgtcgacagcttcggcaccctgaacttcacctctgattttcaggagcgcgatattgttttcggcggcgataaaaagctgaccaaactgatcgaagagatggagctgctgttcccgctgaccaaagggatcaccatccagtcggagtgcccggtgggcctgatcggcgatgacatcagcgccgtagccaacgccagcagcaaggcgctggataaaccggtgatcccggtgcgctgcgaaggctttcgcggcgtatcgcaatcgctgggccaccatatcgccaacgacgtggtgcgcgactgggtgctgaacaatcgcgaagggcagccgtttgccagcaccccgtacgatgttgccatcattggcgattacaacatcggcggcgacgcctgggcctcgcgcattctgctggaagagatggggctgcgcgtagtggcgcagtggtccggcgacggcaccctggtggagatggagaacaccccattcgttaagcttaacctcgtccactgctaccgttcgatgaactatatcgcccgccatatggaggagaaacatcagatcccatggatggaatataacttcttcggcccgaccaaaatcgccgaatcgctgcgcaagatcgccgatcaatttgatgacaccattcgcgccaatgcggaagcggtgatcgccaaatatgaggggcagatggcggccatcatcgccaaatatcgcccgcggctggaggggcgcaaagtgctgctgtacatgggggggctgcggccgcgccacgtcatcggcgcctatgaggatctcgggatggagatcatcgccgccggctacgagtttgcccataacgatgattacgaccgcaccctgccggacctgaaagagggcaccctgctgtttgacgatgccagcagctatgagctggaggccttcgtcaaagcgctgaaacctgacctcatcggctccgggatcaaagagaaatatatcttccagaaaatgggggtgccgttccgccagatgcactcctgggactattccggcccctatcacggctatgacggcttcgccatctttgcccgcgatatggatatgaccctgaacaatccggcgtggaacgaactgactgccccgtggctgaagtctgcgtga

SEQ ID NO: 101 - DNA, 1386 bp, Klebsiella variicola
  gene 1..1386: note = nifK1
  source 1..1386: mol_type = genomic DNA
atggcagatattatccgcagtgaaaaaccgctggcggtgagcccgattaaaaccgggcaaccgctcggggcgatcctcgccagcctcgggctggcccaggccatcccgctggtccacggcgcccagggctgcagcgccttcgccaaagttttctttattcagcatttccatgacccggtgccgctgcagtcgacggccatggatccgaccgccacgatcatgggggccgacggcaatatcttcaccgcgctcgacaccctctgccagcgccacagcccgcaggccatcgtgctgctcagcaccggtctggcggaagcgcagggcagcgatatcgcccgggtggtgcgccagtttcgcgaggcgcatccgcgccataacggcgtggcgatcctcaccgtcaataccccggatttttttggctctatggaaaacggctacagcgcggtgatcgagagcgtgatcgagcagtgggtcgcgccgacgccgcgtccggggcagcggccccggcgggtcaacctgctggtcagccacctctgttcgccaggggatatcgaatggctgggccgctgcgtggaggcctttggcctgcagccggtgatcctgccggacctctcgcagtcaatggatggccacctcggtgaaggggattttacgcccctgacccagggcggcgcctcgctgcgccagattgcccagatgggccagagtctgggcagcttcgccattggcgtgtcgctccagcgggcggcatcgctcctgacccaacgcagccgcggcgacgtgatcgccctgccgcatctgatgaccctcgaccattgcgatacctttatccatcagctggcgaagatgtccggacgccgcgtaccggcctggattgagcgccagcgtggccagctgcaggatgcgatgatcgactgccatatgtggcttcagggccagcgcatggcgatggcggcggagggcgacctgctggcggcgtggtgtgatttcgcccgcagccaggggatgcagcccggcccgctggtcgcccccaccagccaccccagcctgcgccagctgccggtcgagcaagtcgtgccgggggatcttgaggatctgcagcagctgctgagccaccaacccgccgatctgctggtggctaactctcacgcccgcgatctggcggagcagtttgccctgccgctgatccgcgtcggttttcccctcttcgaccggctcggtgagtttcgtcgcgtccgccaggggtacgccggtatgcgagatacgctgtttgaactggccaatctgctgcgcgaccgccatcaccacaccgccctctaccgctcgccgcttcgccagggcgccgacccccagccggcttcaggagacgcttatgccgcccattaa

SEQ ID NO: 102 - DNA, 1563 bp, Klebsiella variicola
  gene 1..1563: note = nifK2
  source 1..1563: mol_type = genomic DNA
atgagccaaacgatcgataaaattcacagctgttatccgctgtttgaacaggatgaataccagaccctgttccagaataaaaagacccttgaagaggcgcacgacgcgcagcgtgtgcaggaggtttttgcctggaccaccaccgccgagtatgaagcgctgaacttccagcgcgaggcgctgaccgtcgacccggccaaagcctgccagccgctcggcgccgtactctgcgcgctggggttcgccggcaccctgccctacgtgcacggctcccagggctgcgtcgcctattttcgcacctactttaaccgccattttaaagagccggtcgcctgcgtctccgactccatgaccgaggacgcggcggtgttcggcggcaacaacaacatgaatctgggcctgcagaatgccagcgcgctgtataaacccgagattatcgccgtctccaccacctgtatggccgaggtgatcggcgacgatctgcaggcgtttatcgccaacgccaaaaaagagggatttgttgacgaccgcatcgccattccttacgcccatacccccagctttatcggcagccatgtcaccggctgggacaatatgttcgaagggttcgcgaagacctttaccgctgactacgccgggcagccgggcaaacagcaaaagctcaatctggtgaccggatttgagacctatctcggcaacttccgcgtgctgaagcggatgatggcgcagatggatgtcccgtgcagcctgctctccgacccatcagaggtgctcgacacccccgccgacggccattaccggatgtacgccggcggcaccagccagcaggagatcaaaaccgcgccggacgccattgacaccctgctgctgcagccgtggcagctggtgaaaagcaaaaaggtggttcaggagatgtggaaccagcccgccaccgaggtggccgttccgctgggcctggccgccaccgacgcgctgctgatgaccgtcagtcagctgaccggcaaaccgatcgccgacgctctgaccctggagcgcggccggctggtcgacatgatgctggattcccacacctggctgcatggcaaaaaattcggcctctacggcgatccggatttcgtgatggggctgacgcgcttcctgctggagctgggctgcgagccgacggtgatcctcagtcataacgccaataaacgctggcaaaaagcgatgaagaaaatgctcgatgcctcgccgtacggtcaggaaagcgaagtgttcatcaactgcgacctgtggcacttccggtcgctgatgttcacccgtcagccggactttatgatcggtaactcctacggcaagtttatccagcgcgataccctggcaaagggcaaagccttcgaagtgccgctgatccgtctgggctttccgctgttcgaccgccatcatctgcaccgccagaccacctggggctatgaaggcgcaatgaacatcgtcacgacgctggtgaacgccgtgctggaaaaactggaccacgacaccagccagttgggcaaaaccgattacagcttcgacctcgttcgttaa

SEQ ID NO: 103 - DNA, 1485 bp, Klebsiella variicola
  gene 1..1485: note = nifL
  source 1..1485: mol_type = genomic DNA
atgaccctgaatatgatgctcgataacgccgcgccggaggccatcgccggcgcgctgactcaacaacatccggggctgttttttaccatggtggaacaggcctcggtggccatctccctcaccgatgccagcgccaggatcatttacgccaacccggcgttttgccgccagaccggctattcgctggcgcaattgttaaaccagaacccgcgcctgctggccagcagccagacgccgcgcgagatctatcaggagatgtggcataccctgctccagcgtcagccctggcgcggtcagctgattaatcagcgtcgggacggcggcctgtacctggtggagattgacatcaccccggtgcttagcccgcaaggggaactggagcattatctggcgatgcagcgggatatcagcgtcagctacaccctcgaacagcggctgcgcaaccatatgaccctgatggaggcggtgctgaataatatccccgccgccgtggtagtggtggacgagcaggatcgggtggtgatggacaacctcgcctacaaaaccttctgcgctgactgcggcggccgggagctgctcaccgagctgcaggtctcccctggccggatgacgcccggcgtggaggcgatcctgccggtggcgctgcgcggggccgcgcgctggctgtcggtaacctgctggccgttgcccggcgtcagtgaagaggccagccgctactttatcgacagcgcgctggcgcggaccctggtggtgatcgccgactgtacccagcagcgtcagcagcaggagcaagggcgccttgaccggctgaagcagcaaatgaccgccggcaagctgctggcggcgatccgcgagtcgctggacgccgcgctgatccagctgaactgcccgattaatatgctggcggcagcccgtcggctgaacggcgagggaagcgggaatgtggcgctggaggccgcctggcgtgaaggggaagaggcgatggcgcggctccagcgctgtcgcccatcgctggaactcgaaaaccccgccgtctggccgctgcagccctttttcgacgatctgtgcgccctctaccgtacacgcttcgatcccgacgggctgcaggtcgacatggcctcaccgcatctgatcggctttggccagcgcaccccactgctggcgtgcttaagcctgtggctcgatcgcaccctggccctcgccgccgaactcccctccgtgccgctggcgatgcagctctacgccgaggagaacgacggctggctgtcgctgtatctgactgacaacgtaccgctgctgcaggtgcgctacgctcactcccccgacgcgctgaactcgccgggcaaaggcatggagctgcggctgatccagaccctggtggcgcaccatcgcggggccattgagctggcttcccgaccgcagggcggcacctgcctgaccctgcgtttcccgctgtttaacaccctgaccggaggtgaagcatga

SEQ ID NO: 104 - DNA, 1575 bp, Klebsiella variicola
  gene 1..1575: note = nifA
  source 1..1575: mol_type = genomic DNA
atgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtcgccaacctcgtcgcccagaccatccggctgatgatccttccggcctcacccgccctgtcgagccgccagccgccgaaggtggaacggccgccggcctgctcgtcgtcgcgcggcgtgggccttgacaatatggtcggcaagagcccggcgatgcgccagatcgtggaggtgatccgtcaggtttcgcgctgggacaccaccgtgctggtacgcggcgaaagcggcaccgggaaagagctgatcgccaacgccatccatcaccattcgccacgggctggcgccgccttcgtcaaatttaactgcgcggcgctgccggacaccctgctggaaagcgaactgttcggccatgagaaaggcgcctttaccggggcggtgcgtcagcgtaaaggacgttttgagctggcggatggcggcaccctgttcctcgatgagattggtgaaagcagcgcctcgttccaggccaagctgctgcgtatcctccaggagggggagatggagcgggtcggcggcgatgagaccctgcgggtgaatgtccgcatcatcgccgccaccaaccgtcacctggaggaggaggtccggctgggccatttccgcgaggatctctactatcgtctgaacgtgatgcccatcgccctgcccccgctgcgcgagcgtcaggaggacatcgccgagctggcgcacttcctggtgcgcaaaatcggccagcatcaggggcgcacgctgcggatcagcgagggcgcgatccgcctgctgatggagtacagctggccgggtaacgttcgcgaactggagaactgcctcgaacgatcggcggtgatgtcggagagtggcctgatcgatcgcgacgtgatcctcttcactcaccaggatcgtcccgccaaagccctgcctgccagcgggccagcggaagacagctggctggacaacagcctggacgaacgtcagcgactgatcgccgcgctggaaaaagccggctgggtgcaggccaaggcggcacggctgctggggatgacgccgcgccaggtcgcttatcggatccagatcatggatatcaccctgccgcgtctgtag

SEQ ID NO: 105 - DNA, 2838 bp, Klebsiella variicola
  gene 1..2838: note = glnE
  source 1..2838: mol_type = genomic DNA
atgatgccgctttctccgcaattacagcagcactggcagacggtcgctgaccgtctgccagcggattttcccattgccgaactgagcccacaggccaggtcggtcatggcgttcagcgattttgtcgaacagagtgtgatcgcccagccgggctggctgaatgagcttgcggactcctcgccggaggcggaagagtggcggcattacgaggcctggctgcaggatcgcctgcaggccgtcactgacgaagcggggttgatgcgagagctgcgtctcttccgccgccagatgatggtccgcatcgcctgggcgcaggcgctgtcgctggtgagcgaagaagagactctgcagcagctgagcgtcctggcggagaccctgattgtcgccgcccgcgactggctgtacgccgcctgctgtaaggagtggggaacgccatgcaatgccgagggccagccgcagccgctgctgatcctcgggatgggaaagctgggcggcggcgagctgaacttctcttccgatatcgatctgatctttgcctggcctgagcatggcgccacccgcggcggccgccgcgagctggataacgcccagttctttacccgtctggggcagcggctgatcaaggcccttgaccagccgacgcaggacggctttgtctatcgggttgacatgcgcctgcggccgtttggcgacagtgggccgctggtactcagttttgcggcgctggaagattattaccaggagcagggtcgggactgggaacgctatgcgatggtgaaagcgcggatcatgggcgataacgacggcgtgtacgccagcgagttgcgcgcgatgctccgtcctttcgtcttccgccgttatatcgacttcagcgtgatccagtcgctgcgtaacatgaaaggcatgatcgcccgcgaagtgcggcgtcgcgggctgaaagacaacatcaagctcggcgccggcgggatccgtgaaattgagtttatcgttcaggtctttcaactgatccgcggtggtcgcgaacctgcactgcagcagcgcgccctgctgccgacgctggcggcgattgatgagctacatctgctgccggaaggcgacgcggcgctgctgcgcgaggcctatctgttcctgcgccggctggaaaacctgctgcaaagcatcaacgatgagcagacccagaccctgccgcaggatgaacttaaccgcgccaggctggcgtgggggatgcataccgaagactgggagacgctgagcgcgcagctggcgagccagatggccaacgtgcggcgagtgtttaatgaactgatcggcgatgatgaggatcagtccccggatgagcaactggccgagtactggcgcgagctgtggcaggatgcgctggaagaagatgacgccagcccggcgctggcgcatttaaacgataccgaccgccgtagcgtgctggcgctgattgccgattttcgtaaagagctggatcggcgcaccatcggcccgcgcggccgccaggtgctggatcagctgatgccgcatctgctgagcgaaatctgctcgcgcgccgatgcgccgctgcctctggcgcggatcacgccgctgttgaccgggatcgtcacccgtaccacctatcttgagctgctgagcgaattccccggcgcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctggaggcgttgcgccagtttaagcaggcgcagcagctgcatatcgcggcggcggatatcgctggtaccctgccggtgatgaaggtcagcgatcacttaacctggcttgccgaagcgatcctcgacgcggtggtgcagcaggcatgggggcagatggtcgctcgctacggccagccgacccacctgcacgatcgccagggtcgcggcttcgccgtcgtcggctacggtaagcttggcggctgggagctgggctacagctccgatctcgatctggtgttcctccatgactgcccggcggaggtgatgaccgacggcgagcgggagattgacggccgtcagttctacctgcggctggcccagcggatcatgcacctgttcagcacccgcacctcgtccggtattctctacgaagtggacgcccggctgcgtccttctggcgcggcggggatgctggtcaccaccgccgacgcgtttgctgactatcagcagaacgaagcctggacgtgggaacatcaggcgctggtgcgcgcccgcgtggtctatggcgacccggcgctgcaggcgcgctttgacgccattcgtcgcgatatcctgaccaccccgcgggaggggatgaccctgcagaccgaggttcgcgagatgcgcgagaagatgcgcgcccaccttggcaacaaacatcccgatcgttttgatatcaaagccgatgccggcgggatcaccgatattgaatttattactcagtatctggtcctacgctatgccagtgacaagccgaagctgacccgctggtctgacaacgtgcgtattcttgagctgctggcgcagaacgacatcatggacgaggaggaggcgcgcgccttaacgcatgcgtacaccaccttgcgtgatgcgctccatcacctggccctgcaggagcagccgggacacgtggcgccagaggccttcagccgggagcgtcagcaggtcagcgccagctggcagaagtggctgatggcttaa

SEQ ID NO: 106 - DNA, 500 bp, Klebsiella variicola
  gene 1..500: note = PinfC
  source 1..500: mol_type = genomic DNA
agcgtcaggtaccggtcatgattcaccgtgcgattctcggttccctggagcgcttcattggcatcctgaccgaagagttcgctggcttcttcccaacctggattgcaccagtgcaggtagtggtcatgaatattaccgattctcaggctgaatacgttaacgaattgacgcgtaaactacaaaatgcgggcattcgtgtaaaagcagacttgagaaatgagaagattggctttaaaatccgcgagcacactttacgtcgtgtcccgtatatgttggtctgtggcgacaaagaagtcgaagccggcaaagtggccgtgcgcacccgtcgcgggaaagacctcggcagcatggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgccctggaagttcgc

SEQ ID NO: 107 - DNA, 1287 bp, Klebsiella variicola
  gene 1..1287: note = amtB
  source 1..1287: mol_type = genomic DNA
atgaaaatggcaacaatgaaatcgggtctgggggcattagcccttcttccgggactggcaatggccgcgcccgcagtggcggacaaagccgataacgcgtttatgatgatttgcaccgcgctggttctgtttatgaccatcccggggatcgcgctgttttacggcggcctgatccgcggcaaaaacgtcctttccatgctgactcaggtgattgtgacctttggcctggtctgcgtactgtgggtgatttatggctataccctggccttcggcaccggcggcagcttcttcggtagttttgactgggtgatgctgaaaaatattgaactgaaagcgctgatgggcaccttctatcagtacatccacgtggccttccagggctcgttcgcctgtatcaccgtcgggctgatcgtgggggcgctggctgagcgtattcgtttctccgccgtgctgatttttgtggtggtgtggatgacgctctcttatgttccgattgcgcacatggtctggggcggcggtctgctggcgacccacggcgcgctggacttcgcgggcggcaccgttgtacacatcaacgccgcggttgccgggctggtgggtgcgtacatgatgggcaaacgtgtgggcttcggcaaagaagcgttcaaaccgcacaatctgccgatggtgttcaccggaaccgccatcctctacgtgggctggttcggcttcaacgccggctccgccagcgcagcgaacgaaattgccgcattggctttcgtcaacaccgtcgtcgccacagcggctgccatcctggcgtggacctttggcgaatgggccctgcgcggtaaaccttcactgctgggcgcctgctccggggcgattgccggtctggttggcgtcacaccagcctgtgggtatatcggtgtcggtggggcgttgattgtgggtatcgcatctggtctggcgggcatctggggcgtaacggcgctgaaacgctggctgcgggttgatgacccttgcgacgtcttcggcgtccacggcgtctgcggcatcgtcggctgtatcctgaccggtatcttcgcggccacctctctgggcggcgtgggttatgcagaaggcgtcaccatgggccatcagctgctggtgcaactcgagagtatcgcgattaccatcgtctggtcgggcgttgtcgctttcattggctacaaagtggcggacatgaccgtggggctgcgcgtaccagaagagcaggagcgcgaaggactggacgtcaacagccatggcgaaaacgcctacaacgcctga

SEQ ID NO: 108 - DNA, 299 bp, Klebsiella variicola
  gene 1..299: note = Prm8.2
  source 1..299: mol_type = genomic DNA
cgccgtcctcgcagtaccattgcaaccgactttacagcaagaagtgattctggcacgcatggaacaaattcttgccagtcgggctttatccgatgacgaacgcgcacagcttttatatgagcgcggagtgttgtatgatagtctcggtctgagggcattagcgcgaaatgatttttcacaagcgctggcaatccgacccgatatgcctgaagtattcaattacttaggcatttacttaacgcaggcaggcaattttgatgctgcctatgaagcgtttgattctgtacttgagcttgatc

SEQ ID NO: 109 - DNA, 300 bp, Klebsiella variicola
  gene 1..300: note = Prm6.2
  source 1..300: mol_type = genomic DNA
gctaaagttctcggctaatcgctgataacatttgacgcaatgcgcaataaaagggcatcatttgatgccctttttgcacgctttcataccagaacctggctcatcagtgattttttttgtcataatcattgctgagacaggctctgaagagggcgtttatacaccaaaccattcgagcggtagcgcgacggcaagtcagcgttctcctttgcaatagcagggaagaggcgccagaaccgccagcgttgaagcagtttgaacgcgttcagtgtataatccgaaacttaatttcggtttgga

SEQ ID NO: 110 - DNA, 400 bp, Klebsiella variicola
  gene 1..400: note = Prm1.2
  source 1..400: mol_type = genomic DNA
gcccgctgaccgaccagaacttccaccttggactcggctatacccttggcgtgacggcgcgcgataactgggactacatccccattccggtgatcttaccattggcgtcaataggttacggtccggcgactttccagatgacctatattcccggcacctacaataacggtaacgtttacttcgcctgggctcgtatacagttttaattcgctaagtcttagcaataaatgagataagcggtgtgtcttgtggaaaaacaaggactaaagcgttacccactaaaaaagatagcgacttttatcactttttagcaaagttgcactggacaaaaggtaccacaattggtgtactgatactcgacacagcattagtgtcgatttttcatataaaggtaattttg

SEQ ID NO: 111 - DNA, 1536 bp, Klebsiella variicola
  gene 1..1536: note = 16S
  variation 245: note = n is a, c, t, g, unknown or other
  variation 452: note = n is a, c, t, g, unknown or other
  variation 454: note = n is a, c, t, g, unknown or other
  variation 1131..1132: note = n is a, c, t, g, unknown or other
  source 1..1536: mol_type = genomic DNA
ttgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctngtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgntnaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtnnggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 112 - DNA, 882 bp, Klebsiella variicola
  gene 1..882: note = nifH
  source 1..882: mol_type = genomic DNA
atgaccatgcgtcaatgcgctatctacggtaaaggcggtatcggtaaatccaccaccacccagaatctcgtcgcggccctcgccgagatgggtaagaaagtgatgatcgtcggctgcgatccgaaagcggactccacccgtctgatccttcacgctaaagcccagaacaccatcatggagatggcggcggaagtgggctcggtcgaggatctggagctcgaagacgttctgcaaatcggctatggcgatgtccgttgcgccgaatccggcggcccggagccaggcgtcggctgcgccggacgcggggtgatcaccgccatcaacttcctcgaggaagaaggcgcctatgaggaagatttggatttcgtcttctatgacgtcctcggcgacgtagtctgcggcggcttcgccatgccgatccgcgaaaacaaagcccaggagatctacatcgtctgctccggcgagatgatggcgatgtatgccgccaacaatatctccaaggggatcgtgaagtacgcgaaatctggcaaggtgcgcctcggcggcctgatctgtaactcgcgcaaaaccgaccgggaagacgaactgatcatcgccctggcggagaagcttggcacgcagatgatccacttcgttccccgcgacaacattgtgcagcgcgcggagatccgccggatgacggtgatcgagtacgacccgacctgtcagcaggcgaatgaatatcgtcaactggcgcagaagatcgtcaataacaccaaaaaagtggtgccaacgccgtgcaccatggacgagctggaatcgctgctgatggagttcggcatcatggaagaagaagacaccagcatcattggtaaaaccgccgctgaagaaaacgcggcctga

SEQ ID NO: 113 - DNA, 1449 bp, Klebsiella variicola
  gene 1..1449: note = nifD1
  source 1..1449: mol_type = genomic DNA
atgaccaacgcaacaggcgaacgtaaccttgcgctcatccaggaagtcctggaggtgtttcccgaaaccgcgcgcaaagagcgcagaaagcacatgatgatcagcgatccgcagatggagagcgtcggcaagtgcattatctcgaaccgtaaatcgcagcccggggtgatgaccgtgcgtggctgcgcctatgcgggctcgaaaggggtggtgtttgggccaatcaaagacatggcccatatctcgcacggccccatcggctgcggccagtactcgcgcgccggacggcgcaactactataccggcgtcagcggtgtcgacagcttcggcaccctgaacttcacctctgattttcaggagcgcgatattgttttcggcggcgataaaaagctgaccaaactgatcgaagagatggagctgctgttcccgctgaccaaagggatcaccatccagtcggagtgcccggtgggcctgatcggcgatgacatcagcgccgtggccaacgccagcagcaaggcgctggataaaccggtgatcccggtgcgctgcgaaggctttcgcggcgtatcgcaatcgctgggccaccatatcgccaacgacgtggtgcgcgactgggtgctgaacaatcgcgaagggcagccgtttgccagcaccccgtatgatgttgccatcattggcgattacaacatcggcggcgacgcctgggcctcgcgcattctgctggaagagatggggctgcgcgtagtggcgcagtggtccggcgacggcaccctggtggagatggagaacaccccattcgttaagcttaacctcgtccactgctaccgttcgatgaactatatcgcccgccatatggaggagaaacatcagatcccgtggatggaatataacttcttcggcccgaccaaaatcgccgaatcgctgcgcaagatcgccgatcaatttgatgacaccattcgcgccaatgcggaagcggtgatcgccaaatatgaggggcagatggcggccatcatcgccaaatatcgcccgcggctggaggggcgcaaagtgctgctgtacatgggggggctgcggccgcgccacgtcatcggcgcctatgaggatctcgggatggagatcatcgccgccggctacgagtttgcccataacgatgattacgaccgcaccctgccggacctgaaagagggcaccctgctgtttgacgatgccagcagctatgagctggaggccttcgtcaaagcgctgaaacctgacctcatcggctccgggatcaaagagaaatatatcttccagaaaatgggggtgccgttccgccagatgcactcctgggactattccggcccctatcacggctatgacggcttcgccatctttgcccgcgatatggatatgaccctgaacaatccggcgtggaacgaactgactgccccgtggctgaagtctgcgtga

SEQ ID NO: 114 - DNA, 1374 bp, Klebsiella variicola
  gene 1..1374: note = nifD2
  source 1..1374: mol_type = genomic DNA
atgaagggaaaggaaattctggcgctgctggacgaacccgcctgcgagcacaaccagaagcaaaaatccggctgcagcgctcctaagcccggcgcaaccgccggcggctgcgccttcgacggcgcgcagataacgctcctgcccatcgccgacgtcgcgcacctggtgcacggccccatcggctgcgcgggcagctcgtgggataaccgcggcagcgtcagcgccggcccggccctcaaccggctcggctttaccaccgatcttaacgaacaggatgtgattatgggccgcggcgaacgccgcctgttccacgccgtccgtcacatcgtcgaccgctatcatccggcggcggtctttatctacaacacctgcgtaccggcgatggagggggatgacctggaggccgtctgccaggccgcacagaccgccaccggcgtcccggtcatcgccattgacgccgccggtttctacggcagtaaaaatcttggcaaccgaatggcgggcgacgtgatgctcaggcaggtgattggccagcgcgaaccggccccgtggccagacaacacgccctttgccccggcccagcgccacgatatcggcctgattggcgaattcaatatcgccggcgagttctggcaggtccagccgctgctcgacgagctggggatccgcgtcctcggcagcctctccggcgacggccgctttgccgagatccagaccctgcaccgggcgcaggccaatatgctggtgtgctcgcgcgcgctgatcaacgtcgcccgggggctggagctgcgctacggcacgccgtggtttgaaggcagcttctacgggatccgcgccacctccgacgccttgcgccagctggcggcgctgctgggggatgacgacctgtgccgccgcaccgaggcgctgatcgcccgcgaagagcaggcggcggagcaggcgctggcgccgtggcgcgagcagctccgtgggcgcaaagtgttgctctacaccggcggcgtgaaatcctggtcggtggtatcagccctgcaggatctcggcatgaccgtggtggccaccggcacgcggaaatccaccgaggaggacaaacagcggatccgtgagctgatgggcgacgaggcggtgatgcttgaggagggcaatgcccgcaccctgctcgacgtggtgtaccgctatcaggccgacctgatgatcgccggcggacgcaatatgtacaccgcctggaaagcccggctgccgtttctcgatatcaatcaggagcgcgagcacgcctacgccggctatcagggcatcatcaccctcgcccgccagctctgtctgaccctcgccagtcccgtctggccgcaaacgcatacccgcgccccgtggcgctag

SEQ ID NO: 115 - DNA, 1386 bp, Klebsiella variicola
  gene 1..1386: note = nifK1
  source 1..1386: mol_type = genomic DNA
atggcagacattatccgcagtgaaaaaccgctggcggtgagcccgattaaaaccgggcaaccgctcggggcgatcctcgccagcctcgggctggcccaggccatcccgctggtccacggcgcccagggctgcagcgccttcgccaaagttttctttattcagcatttccatgacccggtgccgctgcagtcgacggccatggatccgaccgccacgatcatgggggccgacggcaatatcttcaccgcgctcgacaccctctgccagcgccacagcccgcaggccatcgtgctgctcagcaccggtctggcggaagcgcagggcagcgatatcgcccgggtggtgcgccagtttcgtgaggcgcatccgcgccataacggcgtggcgatcctcaccgtcaataccccggatttttttggctcgatggaaaacggctacagcgcggtgatcgagagcgtgatcgagcagtgggtcgcgccgacgccgcgtccggggcagcggccccggcgggtcaacctgctggtcagccacctctgttcgccaggggatatcgaatggctgggccgctgcgtggaggcctttggcctgcagccggtgatcctgccggacctctcgcagtcaatggatggccacctcggtgaaggggattttacgcccctgacccagggcggcgcctcgctgcgccagattgcccagatgggccagagtctgggcagcttcgccattggcgtgtcgctccagcgggcggcatcgctcctgacccaacgcagccgcggcgacgtgatcgccctgccgcatctgatgaccctcgaccattgcgatacctttatccatcagctggcgaagatgtccggacgccgcgtaccggcctggattgagcgccagcgcggccagctgcaggatgcgatgatcgactgccatatgtggcttcagggccagcgcatggcgatggcggcggagggcgacctgctggcggcgtggtgtgatttcgcccgcagccaggggatgcagcccggcccgctggtcgcccccaccagccaccccagcctgcgccagctgccggtcgatcaggtcgtgccgggggatcttgaggatctgcagcagctgctgagccaccaacccgccgatctgctggtggctaactctcacgcccgcgatctggcggagcagtttgccctgccgctgatccgcgtcggttttcccctcttcgaccggctcggtgagtttcgtcgcgtccgccaggggtacgccggtatgcgagatacgctgtttgagctggccaatctgctgcgcgaccgccatcaccacaccgccctctaccgctcgccgcttcgccagggcgccgaccccctgccggcttcaggagacgcttatgccgcccattaa

SEQ ID NO: 116 - DNA, 183 bp, Klebsiella variicola
  gene 1..183: note = nifK2
  source 1..183: mol_type = genomic DNA
gtgccgctgatccgtctgggctttccgctgttcgaccgccatcatctgcaccgccagaccacctggggctatgaaggcgcaatgaacatcgtcacgacgctggtgaacgccgtgctggaaaaactggaccacgacaccagccagttgggcaaaaccgattacagcttcgacctcgttcgttaa

SEQ ID NO: 117 - DNA, 1485 bp, Klebsiella variicola
  gene 1..1485: note = nifL
  source 1..1485: mol_type = genomic DNA
atgaccctgaatatgatgctcgataacgccgcaccggaggccatcgccggcgcgctgactcaacaacatccggggctgttttttaccatggtggaacaggcctcggtggccatatccctcaccgatgccagcgccaggatcatttacgccaacccagcgttttgccgccagaccggctattcgctggcgcaattgttaaaccagaacccgcgcctgctggccagcagccagacgccgcgcgcgatctatcaggagatgtggcataccctgctccagcgtcagccctggcgcggtcagctgattaatcagcgtcgggacggcggcctgtgcctggtggagattgacatcaccccggtgcttagcccgcaaggggaactggagcattatctggcgatgcagcgggatatcagcgtcagctacaccctcgaacaacggctgcgcaaccatatgaccctgatggaggcggtgctgaataatatccccgccgccgtggtggtggtggacgagcaggatcgggtggtgatggacaacctcgcctacaaaaccttctgcgctgactgcggcggccgggagctgctcaccgagctgcaggtctcccctggccggatgacgcccggcgtggaggcgatcctgccggtagcgctgcgcggggccgcgcgctggctgtcggtaacctgctggccgttgcccggcgtcagtgaagaggccagccgctactttatcgacagcgcgctggcgcggaccctggtggtgatcgccgactgtacccagcagcgtcagcagcaggagcaaggacgccttgaccggctgaagcagcaaatgaccgccggcaagctgctggcggcgatccgcgagtcgctggacgccgcgctgatccagctgaactgcccgattaatatgctggcggcagcccgtcggctgaacggcgagggaagcgggaatgtggcgctggaggccgcctggcgtgaaggggaagaggcgatggcgcggctccagcgctgtcgcccatcgctggaactcgaaaaccccgccgtctggccgctgcagccctttttcgacgatctgtgcgccctctaccgtacccgcttcgatcccgacgggctgcaggtcgacatggcctcaccgcatctgatcggctttggccagcgcaccccgctgctggcgtgcttaagcctgtggctcgaccgcaccctggccctcgccgccgaattgccctccgtgccgctggcgatgcagctctatgccgaggagaacgacggctggctgtcgctgtacctgactgataacgtaccgctgttgcaggtgcgctacgcccactcccccgacgcgctgaactcgccgggtaaaggcatggagctgcggctgatccagaccctggtggcgcaccatcgcggggccattgagctggcttcccgaccgcagggcggcacctgcctgaccctgcgtttcccgctgtttaacaccctgaccggaggtgaagcatga

SEQ ID NO: 118 - DNA, 1575 bp, Klebsiella variicola
  gene 1..1575: note = nifA
  source 1..1575: mol_type = genomic DNA
atgatccctgaatccgacccggacaccaccgtcagacgcttcgacctctctcagcagttcaccgccatgcagcggataagcgtggtgctgagccgggccaccgaggccagcaaaacgctgcaggaggtactcactgtattgcacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtcgccaacctcgtcgcccagaccatccggctgatgatccttccggcctcacccgccctgtcgagccgccagccgccgaaggtggaacggccgccggcctgctcgtcgtcgcgcggcgtgggccttgacaatatggtcggcaagagcccggcgatgcgccagatcgtggaggtgatccgtcaggtttcgcgctgggacaccaccgtgctggtgcgcggtgaaagcggcaccgggaaagagctgatcgccaacgccatccatcaccattcgccacgggctggcgccgccttcgtcaaatttaactgcgcggcgctgccggacaccctgctggaaagcgaactgttcggccatgagaaaggcgcctttaccggggcggtgcgtcagcgtaaaggacgttttgagctggcggatggcggcaccctgttcctcgatgagattggtgaaagcagcgcctcgttccaggccaagctgctgcgtatcctccaggagggggagatggagcgggtcggcggcgatgagaccctgcgggtgaatgtccgcatcatcgccgccaccaaccgtcacctggaggaggaggtccggctgggccatttccgcgaggatctctattatcgtctgaacgtgatgcccatcgccctgcccccgctgcgcgagcgtcaggaggacatcgccgagctggcgcacttcctggtgcgcaaaatcggccagcatcaggggcgcacgctgcggatcagcgagggcgcgatccgcctgctgatggagtacagctggccgggtaacgttcgcgaactggagaactgcctcgaacgatcggcggtgatgtcggagagtggcctgatcgatcgcgacgtgatcctcttcactcaccaggatcgtcccgccaaagccctgcctgccagcgggccagcggaagacagctggctggacaacagcctggacgaacgtcagcgactgatcgccgcgctggaaaaagccggctgggtgcaggccaaggcggcacggctgctggggatgacgccgcgccaggtcgcttaccggatccagatcatggatatcaccctgccgcgtctgtag

SEQ ID NO: 119 - DNA, 2838 bp, Klebsiella variicola
  gene 1..2838: note = glnE
  source 1..2838: mol_type = genomic DNA
atgatgccgctttctccgcaattacagcagcactggcagacggtcgctgaccgtctgccagcggattttcccattgcagaactgagcccacaggccaggtcggtcatggcgttcagcgattttgtcgaacagagtgtgatcgcccagccgggctggctgaatgagcttgcggactcctcgccggaggcggaagagtggcggcattacgaggcctggctgcaggatcgcctgcaggccgtcactgacgaagcggggttgatgcgagagctgcgtctcttccgccgccagatgatggtccgcatcgcctgggcgcaggcgctgtcgctggtgagcgaagaagagaccctgcagcagctgagcgccctggcggagaccctgattgtcgccgcccgcgactggctctacgccgcctgctgtaaggagtggggaacgccatgcaatgccgagggccagccgcagccgctgctgatcctcgggatgggaaagctgggcggcggcgagctgaacttctcttccgatatcgatctgatctttgcctggcctgagcatggcgccacccgcggcggccgccgcgagctggataacgcccagttctttacccgtctggggcagcggctgatcaaggcccttgaccagccgacgcaggacggctttgtctatcgggttgacatgcgcctgcggccgtttggcgacagtgggccgctggtactcagctttgcggcactggaagattattaccaggagcagggtcgggactgggaacgctatgcgatggtgaaagcgcggatcatgggcgataacgacggcgtgtacgccagcgagttgcgcgcgatgctccgtcctttcgtcttccgccgttatatcgacttcagcgtgatccagtcgctgcgtaacatgaaaggcatgatcgcccgcgaagtgcggcgtcgcgggctgaaagacaacatcaagctcggcgccggcgggatccgtgaaattgagtttatcgttcaggtctttcagctgatccgcggtggtcgcgaacctgcactgcagcagcgcgccctgctgccgacgctggcggcgattgatgagctacatctgctgccggaaggcgacgcggcgctgctgcgcgaggcctatctgttcctgcgccggctggaaaacctgctgcaaagcatcaacgatgaacagacccagaccctgccgcaggatgaacttaaccgcgccaggctggcgtgggggatgcataccgaagactgggagacgctgagcgcgcagctggcgagccagatggccaacgtgcggcgagtgtttaatgaactgatcggcgatgatgaggatcagtccccggatgagcaactggccgagtactggcgcgagctgtggcaggatgcgctggaagaagatgacgccagcccggcgctggcgcatttaaacgataccgaccgccgtagcgtgctggcgctgattgccgattttcgtaaagagctggatcggcgcaccatcggcccgcgcggccgccaggtgctggatcagctgatgccgcatctgctgagcgaaatctgctcgcgtgccgatgcgccgctgcctctggcgcggatcacgccgctgttgaccgggatcgtcacccgtaccacctatcttgagctgctgagcgaattccccggcgcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctggaggcgttgcgccagtttaagcaggcgcagcagctgcatatcgcggcggcggatatcgctggtaccctgccggtgatgaaggtcagcgatcacttaacctggcttgccgaagcgatcctcgacgcggtggtgcagcaggcatgggggcagatggtcgctcgctacggtcagccgacccacctgcacgatcgccagggtcgcggcttcgccgttgtcggctacggtaagctcggcggctgggagctgggctacagctccgatctcgatctggtgttcctccatgactgcccggcggaggtgatgaccgacggcgagcgggagattgacggccgtcagttctacctgcggctggcccagcggatcatgcacctgttcagcacccgcacctcgtccggtattctctacgaagtggacgcccggctgcgtccttctggcgcggcggggatgctggtcaccaccgccgacgcgtttgctgactatcagcagaacgaagcctggacgtgggaacatcaggcgctggtgcgcgcccgcgtggtctatggcgacccggcgctgcaggcgcgctttgacgccattcgtcgcgatatcctgaccaccccgcgggaggggacgaccctgcagaccgaggttcgcgagatgcgcgagaagatgcgcgcccaccttggcaacaaacatcccgatcgttttgatatcaaagccgatgccggcgggatcaccgatattgaatttattactcagtatctggtcctacgctatgccagtgacaagccgaagctgacccgctggtctgacaacgtgcgtattcttgagctgctggcgcagaacgacatcatggacgaggaggaggcgcgcgccttaacgcatgcatacaccaccttgcgtgatgcgctccatcacctggccctgcaggagcagccgggacacgtggcgccagaggccttcagccgggagcgtcagcaggtcagcgccagctggcagaagtggctgatggcttaa

SEQ ID NO: 120 - DNA, 1287 bp, Klebsiella variicola
  gene 1..1287: note = amtB
  source 1..1287: mol_type = genomic DNA
atgaaaatggcaacaatgaaatcgggtctgggggcattagcccttcttccgggactggcaatggccgcgcccgcagtggcggacaaagccgataacgcgtttatgatgatttgcaccgcgctggttctgtttatgaccatcccggggatcgcgctgttttacggcggcctgatccgcggcaaaaacgtcctttccatgctgactcaggtgattgtgacctttggcctggtctgcgtactgtgggtgatttatggctataccctggccttcggcaccggcggcagcttcttcggtagctttgactgggtgatgctgaaaaatattgaactgaaagcgctgatgggcaccttctatcagtacatccacgtggccttccagggctcgttcgcctgtatcaccgtcgggctgatcgtgggggcgctggctgagcgtattcgtttctccgccgtgctgattttcgtggtggtgtggatgacgctctcttatgttccgattgcgcacatggtctggggcggcggtctgctggcgacccacggcgcgctggacttcgcgggcggcaccgttgtacacatcaacgccgcggttgccgggctggtgggtgcgtatatgatgggcaaacgtgtgggcttcggcaaagaagcgttcaaaccgcacaatctgccgatggtgttcaccggaaccgccatcctctacgtgggctggttcggcttcaacgccggctccgccagcgcagcgaacgaaattgccgcactggctttcgtcaacaccgtcgtcgccacagcggcagccatcctggcctggacctttggcgaatgggctctgcgcggcaaaccttcactgctgggcgcctgctccggggcgattgccggtctggttggcgtcacaccagcctgtgggtatatcggtgtcggtggggcgttgattgtgggtatcgcatctggtctggcgggcatctggggcgtaacggcgctgaaacgctggctgcgggttgatgacccttgcgacgtcttcggcgtccacggcgtctgcggcatcgtcggctgtatcctgaccggtatcttcgcggccacctctctgggcggcgtgggttatgcagaaggcgtcaccatgggccatcagctgctggtgcaactcgagagtatcgcgattaccatcgtctggtcgggcgttgtcgctttcattggctacaaagtggcggacatgaccgtggggctgcgcgtaccagaagagcaggagcgcgaaggactggacgtcaacagccatggcgaaaacgcctacaacgcctga

SEQ ID NO: 121 - DNA, 1435 bp, Achromobacter spiritinus
  gene 1..1435: note = 16S
  variation 255: note = n is a, c, t, g, unknown or other
  variation 454: note = n is a, c, t, g, unknown or other
  source 1..1435: mol_type = genomic DNA
ctgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaanggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggntaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattctgaagagattcggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaacc

SEQ ID NO: 122 - DNA, 1528 bp, Achromobacter marplatensis
  gene 1..1528: note = 16S
  variation 255: note = n is a, c, t, g, unknown or other
  variation 999: note = n is a, c, t, g, unknown or other
  variation 1009: note = n is a, c, t, g, unknown or other
  variation 1437: note = n is a, c, t, g, unknown or other
  source 1..1528: mol_type = genomic DNA
ctgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaanggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcngaagagattnggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgnaaggggggcgattaccacggtaggattcatgactggggtgaagtcgtaacaaggtagccgtatcggaaggtgcggctggatcacctccttt

SEQ ID NO: 123 - DNA, 1522 bp, Microbacterium murale
  gene 1..1522: note = 16S
  source 1..1522: mol_type = genomic DNA
tacggagagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatatgtgacgtggccgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctccttt

SEQ ID NO: 124 - DNA, 1537 bp, Kluyvera intermedia
  gene 1..1537: note = 16S
  variation 455: note = n is a, c, t, g, unknown or other
  variation 1004: note = n is a, c, t, g, unknown or other
  source 1..1537: mol_type = genomic DNA
attgaagagtttgatcatggctcagattgaacgctggcggcaggcctaacacatgcaagtcgaacggtagcacagagagcttgctctcgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagcttgttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgatncggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattnggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 125 - DNA, 882 bp, Kluyvera intermedia
  gene 1..882: note = nifH
  source 1..882: mol_type = genomic DNA
atgaccatgcgtcaatgcgccatttatggcaaaggtgggatcggcaaatccaccaccacgcaaaacctcgtcgccgctctcgcggaaatgggtaaaaaagtgatgatcgtcggctgcgacccgaaagcggactccacccgtctgatcctgcatgcgaaagcacagaacaccattatggagatggccgccgaagtgggttcagtggaagaccttgaactggaagatgtgctgcaaatcggttacggcggcgtgcgttgtgcagaatccggcggcccggagccaggcgtgggttgtgcaggccgcggcgttattaccgccattaacttccttgaagaagaaggcgcctatgtcagcgacctcgactttgtcttctatgacgtcctcggtgacgtggtctgcggcgggttcgccatgccgattcgtgaaaacaaagcgcaagagatctatatcgtctgctccggggaaatgatggcgatgtatgccgctaacaacatctccaaaggcatcgtgaaatacgctaaatccggcaaggtgcgcctgggcgggctgatttgtaactcccgtcagaccgaccgcgaagatgaactgatcatcgcgctggcagaaaaactgggcacccagatgattcactttgtgccacgcgacaacatcgtccagcgcgcggaaattcgccgtatgacggttatcgaatatgacccgaaatgcaaccaggccgacgaataccgcgcgctggcgaacaagatcgtcaacaacaccctgatggtcgtcccgaccccttgcaccatggatgaactggaagagctgctgatggaattcggcattatggatgtggaagacgccagcatcatcggtaaaaccgccgccgaagaaaacgcggcctga

SEQ ID NO: 126 - DNA, 660 bp, Kluyvera intermedia
  source 1..660: mol_type = genomic DNA
  CDS 1..660: note = Dinitrogenase iron-molybdenum cofactor CDS; protein_id = 434; translation = MNDNDVLFWRMLALFQCLPELQPAQILAWLTGERDDALTPAYLDKL NVRELEATFPSETAMMSPARWSRVNACLHGTLPAHLQVKSTTRQGQLRVAFCSQDGLLI NGHFGQGRLFFIYAFDEQGGWLHALRRLPSAPQTQEPNEVRAQLLSDCHLLFCEAIGGP AAARLIRHNIHPMKVSPGMSIAAQCDAITALLSGRLPPWLAKRLEKANPLEERVF
atgaacgataacgatgtccttttctggcgcatgctggcgctatttcagtgtctgccggaactgcaacccgcgcagatcctggcctggctgacaggagaacgcgacgacgccttaaccccggcgtacctcgataagcttaacgtccgcgaactggaagcgaccttcccgtctgaaacggcgatgatgtcgcccgcacgctggagccgcgttaacgcgtgccttcacggtacgctgcccgcacacctgcaggtaaaaagcaccactcgtcaggggcaattacgggtagccttttgttcacaggatggattgctgatcaatggtcattttggtcaggggcggctgttttttatctacgcctttgatgaacagggcggatggctacacgcgttacgccgtcttccctcggccccgcaaacccaggagccgaatgaagttcgcgcgcagctcctgagtgattgccacctgctgttttgtgaagccattggcggccctgcggcggcccggctgattcgtcacaatatccacccgatgaaagtgtcgccagggatgtccattgccgcccagtgtgatgccattaccgcactgctgagcggacgtctgccaccgtggctggcaaaacgtcttgagaaagccaacccgctggaagagcgggtgttttaa

SEQ ID NO: 127 - protein, 219 aa, Kluyvera intermedia
MNDNDVLFWRMLALFQCLPELQPAQILAWLTGERDDALTPAYLDKLNVRELEATFPSETAMMSPARWSRVNACLHGTLPAHLQVKSTTRQGQLRVAFCSQDGLLINGHFGQGRLFFIYAFDEQGGWLHALRRLPSAPQTQEPNEVRAQLLSDCHLLFCEAIGGPAAARLIRHNIHPMKVSPGMSIAAQCDAITALLSGRLPPWLAKRLEKANPLEERVF

SEQ ID NO: 128 - DNA, 1374 bp, Kluyvera intermedia
  gene 1..1374: note = nifD1
  source 1..1374: mol_type = genomic DNA
atgaagggaaatgacattctcgcgctgctggatgaacccgcctgcgaacacaatcacaaacagaaatccggctgtagcgcccctaaacccggtgccacggcgggcggttgcgcgttcgacggcgcgcaaatcaccctgttgccgctgtcggatgtggcgcacctggtccacggaccgattggctgcacgggaagctcctgggataaccggggcagtatgagctccggccccagtctcaaccggctcggctttaccaccgacctgaacgagcaggatgtcattatggggcgcggcgaacggcggcttttccacgcggtgcgtcatatcgtcaaccgttatcaccctgccgccgtgtttatctataacacctgcgttccggcgatggagggtgatgatattgacgccgtctgtcaggcggcggaaaccgccaccggcgtgccagtgattgccgttgatgccgccgggttctatggcagcaaaaaccttggcaaccgtctcgcgggtgaagtgatggttaacaaggtcattggacggcgcccgcccgccccctggccggacgatacccccttcgcgccggaacaccgccacgatatcggcctgattggcgaatttaatatcgccggggagttctggcacgttcagccgctgctcgatgagctgggtattcgcgtgctgggcagcctttccggggatggccgttttagtgaaatccagaccctgcaccacgcgcaggtcaatatgctggtctgctcaagagcgctgatcaatgttgcccgcaccctggaacagcgctatggcaccccctggtttgagggcagtttttacggcgtgcgcgctacctccgatgccctgcgtcaactggcatccctgcttggcgacagcgatctgattgcccgcaccgaagccgttattgcccgcgaagaagccacggcaaatcaggcgctcgccccgtggcgcgaacggctacagggtcgcaaagtgctgctctataccggtggggtgaaatcctggtcggtggtctccgcattgcaggatttagggatgaccgtcgtggcgactggcacccgcaaatctaccgaagaagataagcagcgtattcgcgaattaatgggcgatgacgcgctaatgctggaagaaggcaacgcccgcaccctgctggatgtggtgtaccgctatcaggcggatttgatgatcgctggggggcgtaacatgtataccgcgtacaaagcgcggctgccgtttctggatatcaaccaggagcgtgaacacgcctttgcgggttatcgcggcatcgtcaccctcgcccaacagctttgccagactattgaaagccccgtctggccgcaaacacacgcccgcgcgccgtggcaataa

SEQ ID NO: 129 - DNA, 1449 bp, Kluyvera intermedia
  gene 1..1449: note = nifD2
  source 1..1449: mol_type = genomic DNA
atgagcaatgcaacaggcgaacgtaatctggaaattatccaggaagtgctggagatctttcccgaaaaaacgcgcaaagaacgcagaaagcacatgatggtgaccgacccggagatggaaagcgtcgggaaatgcatcatctctaaccgcaaatcgcagccgggtgtgatgactgtccgcggctgctcctacgccgggtcgaaaggcgtggtttttgggccgattaaagatatggcccacatctcccacggcccgatcggctgtgggcagtactcccgtgccgggcggcgcaactactacaccggggtcagcggcgttgattccttcgggacgctgaactttacctctgattttcaggagcgcgatatcgtcttcggcggcgataaaaagctcaccaaactgattgaggagatggaggaactgttcccgctgaccaaaggcatctccattcagtcggagtgcccggtaggtttaatcggtgacgatatcgaagcggtggcgaatgccagtaaaaaagcgctcaacaagccggtgatcccggtgcgttgcgaaggctttcgcggcgtgtcgcagtcgctcggtcaccatatcgccaacgacgttatccgcgactgggtgctggataaccgcgaagggaagcccttcgaatctaccccctatgacgtggccatcatcggcgattacaacatcgggggggatgcctgggcgtcgcgcattctgcttgaagagatggggttacgcgtggtggcgcagtggtccggtgacggcacgctggtagagatggaaaacaccccgttcgtcaagctgaacctggtgcactgctaccgctctatgaactacatctctcgccatatggaagagaaacacggtatcccgtggatggagtacaacttcttcggcccgaccaaaatcgccgaatcgctgcgtaagatcgccgatcaatttgacgacaccatccgcgccaatgcggaagcggtgatcgccaaatatcaggcgcaaaacgatgcgattatcgccaaataccgcccgcgtctcgaaggccgcaaggtgctgctctatatgggtggcctgcgtcctcgccacgtgattggcgcgtatgaggatttgggcatggagattgtcgccgccgggtatgaatttgcccataacgacgattacgaccgcaccctgccggacctcaaagagggcacgctgttgttcgacgatgccagcagttatgaactggaagccttcgtgaaggcgattaagccggacctcattggctcaggcatcaaggaaaaatacattttccagaaaatgggggtaccgtttcgccagatgcactcctgggattactccggcccgtatcacggctatgacggctttgccatctttgcccgcgatatggacatgacgctcaacaatcccgcctggggcgagttgaccgcaccctggctgaaatcagcctga

SEQ ID NO: 130 - DNA, 1383 bp, Kluyvera intermedia
  gene 1..1383: note = nifK1
  source 1..1383: mol_type = genomic DNA
atggcagatatcatccgtaatcagaaaccgctggcggtaagcccggtaaaaagcggccagccgttaggcgccattctggcgagcctcggctttgagcacagtattccactggtgcacggtgcgcagggatgcagcgcgttcgccaaagtgttttttatccaacattttcatgaccctattccgctgcaatccacggcgatggaccccacctcaacggtcatgggggcggacggcaatatccttgccgcgctcaatacgctgtgccagcgcaacaccccgaaagctatcgtcctgttgagtaccggcctgtctgaggcgcagggcagcgatatcagccgcgtggtacgtcagtttcgtgaggattttccccgccacaaaaatatcgccctcctgacggtcaacaccccggatttttacggcacgctggagaacggctttagtgcggtggtggaaagcgtcatcgaacagtgggtgccggaaaagcctcagcatggcctgcgtaaccggcgggtcaacttgttgttaagtcacctgctgacgcccggtgatgttgagttgctgcgcagctacgtggaggcttttggcctgcaaccggtgatcgtgccggatctttcacagtcgctggatggtcacctggcaagcggtgatttttcgccggtcactcaggggggaacgcccctgcgcattatcgaacagatgggacagagcctgtgcacgtttgctattggcgtgtcgctgtcccgtgcggcatcgctgctggcacagcgtagccgtggcgaggtgatcgtgcttccccatctgatgaccatggaacattgcgaccgttttattcatcaactgaagatcatttccgggcgcgaggttcccgcctggattgagcgccagcgcggacaattgcaggatgcgatgatcgattgtcatatgtggttgcaggatacccggctcgcgctggccgccgagggcgatctgctggcgggctggtgtgatttcgcccgtagccagggcatgctccccggccccgttgtggcgccggtcagccagccgggcctgcaacagcttcccgtggagaaagtggtcattggcgatctggaagatatgcaggatttactctgcgctatgcctgctgacctgctggtcgccaactcccatgccgcagacctggccgaacaattctccatcccgctgatccgcgccgggttccctatcttcgacaggcttggcgaatttcgtcgcgtgcgtcagggataccccggcattcgcgacacgctgtttgagctggcgaacctgatgcgcgaacgtcatcaccacctgcccgtctaccgctcccccctgcgccagcaatttgcccaggacgctgacggaggccgctatgcaacatgttaa

SEQ ID NO: 131 - DNA, 1563 bp, Kluyvera intermedia
  gene 1..1563: note = nifK2
  source 1..1563: mol_type = genomic DNA
atgagccaaactgctgagaaaattgtcacctgtcatccgctgtttgaacaggacgaataccagacgctgtttcgcaataagcgcggtctggaagaggcgcacgacccgcagcgcgtgcaagaggtttttgaatggaccaccacggcggagtatgaagcgctgaactttaagcgtgaagcgttaaccgtcgatccggcaaaggcctgccagcctttaggatcggtactctgctcgctgggttttgccaatacgctgccttatgtgcacggttcccagggctgtgtggcctatttccgcacctattttaaccgtcatttcaaagagccgatcgcttgcgtttccgactctatgacagaggatgcggcggtcttcggcggcaacaacaaccttaacaccgggttgcaaaatgccagcgccctgtacaaaccggaaattgtcgctgtctccactacctgtatggcggaggtcatcggcgatgacctgcaggcctttatcgccaacgccaaaaaggacgggtttattgatgccgccattccggtgccctacgcccatacgccaagttttatcggtagccacatcaccggctgggacaacatgtttgaaggtttcgcccgggcatttaccgccgatcacgtggcgcaaccgggcaaactggcgaagctaaacctggtgaccggttttgaaacctatcttggcaattaccgcgtgctcaaacgcatgatggcccagatggaggtgccctgtagcctgctgtctgacccgtctgaggtgttagatacgccagccgacggccactatcgcatgtatgcgggcggcacaacgcaacaagagatgcgcgacgcccccgatgctatcgacaccctgctgctgcaaccctggcatctggtgaagagtaaaaaagtggtgcaggagtcctggggccagcccgccacagaagtgtccatcccaatgggactgaccgggaccgacgaactgctgatggcagtcagtcagttaaccggcaaaccggtggccgatgaactgacgctggagcgtgggcgcctggtggatatgattctcgattcacacacctggctgcacggtaagaaattcggtctctacggcgatccggattttgtgatggggctgacgcgtttcctgctggaactgggctgcgagccgacggttatcctctgtcataacggtagcaagcgctggcagaaagcgatgaagaaaatgcttgaggcatcgccctacggtcaggagagcgaagtgttcatcaactgcgatctgtggcatttccgctcgctgatgtttacccgcaaaccggactttatgatcggcaactcgtacgccaaattcatccagcgtgacacgctggcgaaaggcgaacagtttgaagttccgctgatccgtcttggcttcccgttgttcgaccgccaccacctgcatcgccagaccacatggggttatgaaggggcgatgaatatcgtcaccaccctggtcaacgccgtgctggaaaaagtcgaccgcgataccatcaaactgggcaaaacggactacagcttcgaccttgtccgctaa

SEQ ID NO: 132 - DNA, 1488 bp, Kluyvera intermedia
  gene 1..1488: note = nifL
  source 1..1488: mol_type = genomic DNA
atgacctttaatatgatgctggagaccagcgcaccgcagcacattgcgggcaacctctcacttcaacatcccggactgttttccacgatggttgaacaggctccgatcgcgatttcgctgaccgacccggacgcgaggattctgtacgctaatccggccttttgtcgccagaccggttatagcctggaagagctgctcaaccagaaccatcgcatactggcaagccaacagacgccgcgcagcatttatcaggaactgtggcaaacgctgctgcaacagatgccctggcgcggtcagctcatcaatcgccgtcgggatggcagcctttatctggctgaggtcgatatcaccccggtcgtcaacaaacagggcgaactggaacactacctcgccatgcaacgtgatatcagcgccagctatgcgctcgaacagcgattgcgcaatcacaccaccatgagcgaggcggtgctgaacaacattcctgccgccgtggtggtggtcaacgagcaggaccaggtagtcatggacaacctcgcctacaaaaccttctgtgccgactgcggtggcaaggagctgctcaccgaactggatttctcccggcgcaaaagcgatctctatgccgggcaaatactgcctgtggtgctgcgcggcgccgtgcgctggctctctgtcacctgctggaccttgccgggggtgagcgaagaagccagccgctactttattgataccgcgctgccccgcaccctggtggtgatcaccgactgcacccagcaacaacaacaggccgaacagggccgtctcgatcgtctcaaacaggagatgaccaccgggaagctgctggccgcgatccgtgaatcgttggatgccgcgctggttcagctaaactgccccatcaatatgctggcggcggcgcgacgtctcaacggtgaagataaccataacgtggcgctggatgccgcgtggcgcgagggggaagaggcgctggcccgcctgcaacgctgccgcccttctctcgatctggaagagagcgcgctgtggcctctgcaaccgctgtttgacgacctgcgcgccctttaccatacccgctataacaatggcgaaaatctgcacgttgaaatggcctctccgcatctggcggggtttggtcagcgcacgcagatccttgcctgtctcagtttgtggctcgaccgtacgctggccctcgccgccgcgctaccggacagaacgctgcatacccagctttacgcccgtgaagaagatggctggctgtccatttggctgacagataatgtgccgctcatccatgtgcgatacgcccactcccccgatgccctgaacgcccccggcaaagggatggagctgcgattgattcaaaccctggttgcccatcatcgcggcgcaatagaactaactacccgccctgaaggcggtacctgcctgaccctgcgattcccgttatttcattcactgaccggaggcccacgatga

SEQ ID NO: 133 - DNA, 1572 bp, Kluyvera intermedia
  gene 1..1572: note = nifA
  source 1..1572: mol_type = genomic DNA
atgacccagcgacccgagtcgggcaccaccgtctggcgttttgatctctcacagcaatttaccgccatgcagcgcatcagcgtggtgttgagtcgcgcaaccgagataagccagacgctgcaggaggtgctgtgtgttctgcataatgacgcatttatgcaacacggcatgctgtgtctgtatgacaaccagcaggaaattctgagtattgaagccttgcaggaggcagaccaacatctgatccccggcagctcgcaaattcgctatcgccctggcgaagggctggtaggagccgtactgtcccagggacaatctcttgtgctgccgcgtgtcgccgacgatcaacgctttctcgacaggcttggcatctatgattacaacctgccgtttatcgccgtccccttaatggggccaggcgcgcagacgattggcgtgctcgccgcgcagccgatggcgcgtctggaggagcggcttccttcctgtacgcgctttctggaaaccgtcgccaatctggtcgcacagacagtccggctgatgaccccgcctgccgccgccacaccgcgcgccgcgattgcccagaccgaacgccagcgcaactgtggcactcctcgccccttcggctttgagaatatggtgggcaaaagcccggccatgcagcagacaatggacattatccgccaggtttcgcgctgggataccacggtactggtgcgcggcgaaagcggcaccggtaaagaacttatcgccaatgctattcatcacaactcccctcgcgccgccgcgccctttgtgaaatttaactgcgcggcgctaccggatacgctactggagagcgaattgttcggccatgaaaaaggggcgttcaccggcgcggttcgccagcgtaaaggacgttttgaactggccgatggcggcacactgtttcttgatgaaattggcgaaagcagcgcctcgttccaggccaaactgctgcgtattttgcaggagggtgaaatggagcgcgttggcggcgacgaaaccctgcgcgtcaatgtgcgtatcatcgccgccaccaaccggaatctggaagaagaggtgcggatgggcaatttccgcgaggatctctattatcgcctcaacgtaatgcccatctccctgcccccgctgcgtgaacgtcaggaggacattgccgagctggcgcactttctggtgcgcaaaatcgcccataaccaggggcgtacgctgcgcatcagtgatggcgccatccgtctgctgatgggttacaactggcccggtaacgtgcgtgagctggaaaattgcctggaacgttcggcagtgatgtcagaaaacggcctgatcgaccgcgatgtggtgctctttaaccaccgtgagaacacgccaaaactcgctatcgccgccgcgccaaaagaggatagctggcttgatcaaacgctggatgaacgtcaacggctgattgccgcgctggaaaaagccgggtgggtgcaggccaaagcggcgcgtctgctgggtatgacgccccgtcaggtcgcctatcggatacaaattatggatatcagcatgcccaggatgtga

SEQ ID NO: 134 - DNA, 2853 bp, Kluyvera intermedia
  gene 1..2853: note = glnE
  source 1..2853: mol_type = genomic DNA
atgatgccgcactctccacagctacagcagcactggcaaactgtactggcccgcttgcctgagtcattcagtgaaacaccgcttagtgaacaagcgcagttagtgcttactttcagtgattttgtgcaggatagccttgccgcgcatcctgactggctggctgagctggaaagcgcaccgccacaggcggacgagtggaagcagtatgcgcaaacccttcgcgaatcgctggaaggtgtgggagatgaggcatcattaatgcgtgcgctgcgcctgttccgtcgccatatgatggtgcgcattgcctgggcgcagtcgctggcgctggtggcagaagatgagacgttgcagcagttgagcgtactggcggagaccctgatcgtcgctgcacgcgactggctttacgatgcctgctgtcgcgagtggggaacgccgtgcaatcagcagggggaaccgcagccgttgctgatcctgggcatgggcaagctgggtggcggggagcttaacttttcgtccgatatcgatctgatttttgcctggccggaaaacggttcaacgcgcggtgggcgacgcgaacttgataacgcccagttttttactcgcttgggacagcgcctgatcaaagtgctcgaccagccgacgcaggatggctttgtctatcgcgtggatatgcggctgcgcccgtttggcgacagcggtccgctggtgctgagttttgccgcgctggaagattattatcaggagcaggggcgcgactgggaacgttatgcgatggtgaaagcccgcattatgggcgataaggacgatgtttacgctggcgaattacgggccatgctgcggccgttcgtcttccgtcgctatatcgatttcagcgttattcagtctctgcgtaacatgaaagggatgattgcccgcgaagtgcgccgccgtggtctgaaagataacattaagctgggcgcgggcggcatccgtgagattgagtttatcgttcaggtgttccagttgatacgcggtgggcgcgagccgtcgttgcagtcccgttcactgttaccgacgctggacgctatcgataagctgggtttgctgccgcctggcgatgcaccggcgttacgccaggcctatttgtatctgcgccgtctggaaaacctgctgcaaagcattaacgacgaacaaacgcagacgctgccgacagatgaactcaatcgcgcgcgtctggcctgggggatgcgggtcgcagactgggaaaccctgaccgctgagcttgaaaagcagatgtctgccgtacgagggatattcaacaccctgattggcgatgacgaagccgaagagcagggggatgcgctctgcgggcaatggagtgagttgtggcaggatgcgtttcaggaagatgacagcacgcctgtgctggcgcacctttctgacgatgatcgccgccgcgtggtcgcgatgattgctgattttcgcaaagagctggataaacgcaccattggcccacgcggccgccaggtgctcgaccatctgatgccgcatctgttgagtgatgtctgctcccgtgaggatgcccctgtaccgttgtctcgcgtgacgccgctgttaacgggaattgtcacgcgtacgacgtatcttgagctgctcagcgagtttcctggtgcgcgtaagcatctgatttcactctgtgccgcctcgccgatggtggccagtaagctggcgcgctatccgttattgctggatgagttgctcgatccgaataccctttatcagcccacggcgatgaatgcctaccgggatgagctacgtcagtatctgctgcgtgtgccggatgacgatgaagagcagcaactggaggcgttacgccagtttaaacaggctcaattgttgcgtgtggcggcagcagatctggcaggcacactccccgtgatgaaagtgagcgatcacttaacatggcttgccgaagccatcattgaagccgtggtacaacaggcgtggagcctgatggtatcgcgttatgggcagccgaaacacttacgcgaccgtgaaggccgtgggtttgcagtggtcggttacggcaaactgggcggttgggagctgggctatagttccgatctggatttgattttccttcatgactgtccggtggacgtgatgactgacggcgagcgggaaatcgatggccgccaattttatctgcgccttgcccagcgcgtgatgcacctgttcagtacgcgcacctcatccgggatcctgtatgaggtagacgcgcgcttgcgcccgtccggtgcggcgggaatgctggtgacctcaaccgaatcctttgccgactaccagcgcaccgaagcctggacctgggaacatcaggcgctggttcgcgcccgcgttgtctatggcgatccacaattaaacgcgcaatttgatgccatccgccgcgatatcaccatgaccgtgcgtaatggtgcaacgttacaaaccgaggtgcgcgagatgcgcgaaaaaatgcgcgcccacttgagcaataagcacaaggatcgctttgatattaaagccgatgagggtggaattaccgatatcgaatttatcacccagtatctggtgctgcgttatgcccatgccaaaccgaaactgacgcgctggtcggacaatgtccgcattctggaagggctggcgcaaaacggcattatggaagagcaggaagcgcaggcacttaccaccgcctatacaacgttgcgtgatgagctgcatcacctggcgctacaggagctgccaggacatgttccggaggcatgttttgtcgctgaacgcgcgatggtgcgagcctgctggaacaagtggttggtggagccgtgcgaggacgcgtaa

SEQ ID NO: 135 - DNA, 1290 bp, Kluyvera intermedia
  gene 1..1290: note = amtB
  source 1..1290: mol_type = genomic DNA
atgaagaaagcactattaaaagcgggtctggcctcgctggcattactgccgtgtctggctatggcagccgatccggttgtcgtcgataaagccgacaatgcctttatgatgatttgcaccgcgctggtgctgtttatgtcaattccgggcatcgccctgttctatggtggtttaatccgcggtaaaaacgtcctttctatgctgacacaggttgcggttacgttcgcactggtgtgcgtgctgtgggtggtttacggctactctctggcctttggcactggcggcagcttcttcggtagcttcgactgggtgatgctgaaaaatattgagctgaaagcgctgatgggcaccatctatcagtacattcacgttgcgttccagggctcgtttgcctgtattaccgtcggcctgattgtcggtgcgctggcagaacgtatccgtttctccgcagtactgattttcgtcgtggtatggctgacgctgtcctacgtgccgatcgcacacatggtctggggcggcggtctgctggcaacccatggcgccatggattttgcgggcggtacagtcgttcacatcaacgcagccgttgcaggcctggtgggtgcttacctgattggcaaacgtgtcggtttcggtaaagaagcgtttaaaccgcacaacctgccgatggtgtttaccggtacggcaatcctctactttggctggttcggattcaacgcgggttctgcaagcgcggcgaacgaaattgcgggtctggcttttgttaacaccgtcgtggcaacagcgggtgcaatcctctcctgggtcttcggtgagtgggcgctgcgcggcaaaccgtctctgttgggtgcctgttctggtgcgattgctggcctcgtgggtatcaccccggcgtgtggttacgttggtgtgggtggcgcgctgatcgtgggcatcgttgcaggcctggcgggtctgtggggcgttaccgcgctgaaacgctggctgcgtgttgacgacccgtgtgatgtcttcggtgttcacggcgtgtgcggtatcgtaggttgtatcatgacaggtatcttcgcagccacttcactgggcggcgtgggttatgccgaaggcgtgaccatgggccatcaggttctggtacaactggaaagtatcgccattactatcgtatggtctggtatcgtcgcctttatcggttacaaactggctgatatgacagtgggtctgcgtgttccggaagatcaggaacgcgaagggctggacgtcaacagccacggcgagaacgcctacaacgcctga

SEQ ID NO: 136 - DNA, 498 bp, Kluyvera intermedia
  gene 1..498: note = PinfC
  source 1..498: mol_type = genomic DNA
ctggggtcactggagcgctttatcggcatcctgaccgaagaatttgccggtttcttcccgacctggctggcccctgttcaggttgtggtgatgaatatcactgattctcaagctgaatatgtcaacgaattgacccgtaaattgcaaaatgcgggcattcgtgtaaaagcggacttgagaaacgagaagattggctttaaaatccgcgagcacactttacgtcgtgtcccttatatgttggtctgtggtgataaagaggtggaagcaggcaaagtggccgttcgcacccgccgcggtaaagacctgggcagcctggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgcccaggaagttcgcttaactggtctggaaggtgagcagctgggtatt

SEQ ID NO: 137 - DNA, 1537 bp, Kosakonia pseudosacchari
  gene 1..1537: note = 16S
  variation 454: note = n is a, c, t, g, unknown or other
  source 1..1537: mol_type = genomic DNA
attgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcganacggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaacttgccagagatggcttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 138 - DNA, 882 bp, Kosakonia pseudosacchari
  gene 1..882: note = nifH
  source 1..882: mol_type = genomic DNA
atgaccatgcgtcaatgcgccatttacggcaaaggtgggatcggtaaatcgaccaccacacagaacctggtcgccgcgctggcggagatgggtaagaaagtcatgatcgtcggctgcgatccgaaagccgactccacgcgtttgatcctgcatgcgaaagcgcagaacaccattatggagatggccgccgaagtcggctccgtcgaagacctggaattagaagacgtgctgcaaatcggttacggcggcgtgcgctgcgcggaatccggtggcccggagccaggtgtgggttgtgccggtcgtggcgtgatcaccgcgattaacttcctcgaagaagaaggcgcttacgtgccggatctggattttgttttctacgacgtgctgggcgacgtggtatgcggtggtttcgccatgccgattcgtgaaaacaaagcgcaggagatctacatcgtttgctctggcgaaatgatggcgatgtacgccgccaataacatctccaaaggcatcgtgaaatatgccaaatccggtaaagtgcgcctcggcgggctgatttgtaactcgcgccagaccgaccgcgaagatgaactcatcattgcgctggcggaaaaactcggcacgcaaatgatccactttgttccccgcgacaacattgtgcagcgtgcggaaatccgccgtatgacggttatcgaatatgacccgacctgcaatcaggccaacgaatatcgcagccttgccagcaaaatcgtcaacaacaccaaaatggtggtaccaaccccctgcaccatggatgaactggaagaactgctgatggagttcggcattatggatgtggaagacgccagcatcattggtaaaaccgccgccgaagaaaacgccgtctga

SEQ ID NO: 139 - DNA, 1449 bp, Kosakonia pseudosacchari
  gene 1..1449: note = nifD1
  source 1..1449: mol_type = genomic DNA
atgagcaatgcaacaggcgaacgtaacctggaaatcatcgagcaggtgctggaggttttcccggaaaagacgcgcaaagagcgcagaaaacacatgatggtgacggacccggagcaggagagcgtcggcaagtgcatcatctctaaccgcaaatcgcagccgggcgtgatgaccgtgcgtggctgctcgtatgccggatcaaaaggggtggtatttgggccaatcaaagatatggcgcatatctcccacggcccgatcggctgcgggcagtactcccgcgccgggcggcgtaactactataccggcgtcagcggcgtggacagtttcggcacgctcaacttcacctccgatttccaggagcgcgacatcgtgtttggcggcgacaaaaagctcgccaaactgattgaagagctggaagaactgtttccgctgaccaaaggcatttcgattcagtcggaatgcccggtcggcctgattggcgatgatattgaagccgtggcgaacgccagccgcaaagcgatcaacaaaccggttattccggtgcgttgcgaaggctttcgcggcgtgtcgcaatccctcggtcaccatattgccaacgatgtgatccgcgactgggtactggataaccgcgaaggcaaaccgtttgaatccaccccttacgatgtggcgatcatcggcgattacaacatcggtggcgacgcctgggcctcgcgcattttgctcgaagagatggggttgcgggtggtcgcgcagtggtccggcgacggtacgctggtggagatggaaaacacgccgttcgtcaaactgaacctggtgcactgctaccgctcgatgaactacatctcgcgccatatggaggagaagcacggtattccgtggatggaatacaacttctttggcccgacgaaaatcgcggaatcgctgcgcaaaatcgccgacctgttcgacgacaccattcgcgccaacgccgaagcggtgatcgcccgataccaggcgcagaacgacgccattatcgccaaatatcgcccacgtctggagggtcgcaaagtgttgctctatatgggcgggctgcgtccgcgccatgtgattggcgcctatgaagatctgggaatggagatcatcgccgccggttatgagtttggtcataacgacgattacgaccgcaccctgccggatctgaaagagggcacgctgctgtttgatgacgccagcagctatgagctggaggcgtttgtcaacgcgctgaaaccggatctcatcggttccggcatcaaagagaagtacatctttcagaaaatgggcgtgccgtttcgccagatgcactcctgggattactccggcccgtaccacggctatgacggcttcgccatcttcgcccgcgatatggatatgacgctcaacaaccccgcctggggtcagttgaccgcgccgtggcttaaatccgcctga

SEQ ID NO: 140 - DNA, 1374 bp, Kosakonia pseudosacchari
  gene 1..1374: note = nifD2
  source 1..1374: mol_type = genomic DNA
atgaaggggaacgacatcctggctctgctcgatgaaccagcctgcgagcataaccataaacagaaaaccggctgtagcgcgccaaaacccggcgccaccgccggaggctgcgccttcgacggcgcacagatcaccctgctgccactttccgatgtggcgcatctggtacatggcccgattggctgcgccggcagctcatgggataaccgtggcagcctgagttctggcccgctgattaaccgactcggattcaccactgatttgaacgaacaggatgtcatcatggggcgcggcgagcggcggttgtttcacgcggtgcgccatattgtcgagcgctatcacccggcggcggtatttatttacaacacctgcgttccggctatggaaggcgatgacattgacgcggtctgccaggccgccgcgaccgccaccggtgtgcccgtgattgccgtagatgtggccggtttttacggtagcaaaaacctgggtaaccgcctcgcgggcgaggtgatggtgaaaaaagttatcggcgggcgcgaacccgcgccgtggccggacaatacaccttttgccccggcgcaccgccatgacataggcctgattggcgaatttaacatcgccggcgagttctggcatatccagccgctgcttgatgagctgggtattcgcgtccttggctccctttccggcgacgggcgctttgccgagatccagacgttgcaccgcgcgcaggtcaatatgctggtgtgctccagggcgctgattaatgtcgccagatcgcttgaacaacgttatggcacaccctggtttgaaggcagtttttatggcgttcgcgccacctccgatgccctgcgccagctggcaacactcaccggcgatagcgatttaatggcgcgaaccgaacggctgatcgcacgtgaagagcaagccacagaacaggcgctagcaccgctgcgtgaacggttacacggccggaaagtgctgctctataccggtggcgtgaaatcctggtcggtggtttcggcgctgcaggatctcggcatgacggtcgttgctaccggaacgcgcaaatccaccgaagaggataaacaacgcatccgtgaactgatgggcgatgacgccatcatgctggatgaaggcaatgcccgcgccttgctggatgtggtctatcgctacaaagccgacatgatgatcgcgggcgggcgcaacatgtacaccgcctataaagcgcgtctgccctttctggatatcaaccaggagcgtgaacacgcgtttgccggttatcgcggcatcatcacgcttgccgaacaactttgtcagacgctggaaagcccggtctggccgcaaacacatgcccgcgccccgtggcaataa

SEQ ID NO: 141 - DNA, 1563 bp, Kosakonia pseudosacchari
  gene 1..1563: note = nifK1
  source 1..1563: mol_type = genomic DNA
atgagccagactgctgagaaaatacagaattgccatcccctgtttgaacaggacgcctaccagacactatttgccggtaaacgggcactcgaagaggctcactcgccggagcgggtgcaggaagtgtttcaatggaccaccaccccggaatacgaagcgctgaacttcaaacgcgaagcgctgactatcgacccggcaaaagcctgccagccgctgggggcggtgctctgttcgctggggtttgccaacaccctgccgtatgtgcacggttcacagggttgtgtggcctatttccgtacgtactttaaccgccacttcaaagaaccggtggcctgcgtgtcggattcgatgacggaagacgcggccgtgttcggcgggaataacaacctcaacaccgggttacaaaacgccagcgcactgtataaaccggagattatcgccgtctctaccacctgtatggcggaagtgatcggtgatgatttacaggcgtttatcgccaacgccaaaaaagatggttttctcgatgccgccatccccgtgccctacgcccacacccccagttttatcggtagccatatcaccggctgggacaacatgtttgaaggttttgcccgtacctttaccgcaaaccatcagccacagcccggtaaactttcacgcctgaacctggtgaccgggtttgaaacctatctcggcaatttccgcgtgctgaaacgcatgatggaacaaatggaggtgcaggcgagtgtgctctccgatccgtcggaggtgctggacacccccgccaatggccattaccagatgtacgcgggcggtacgacgcagcaagagatgcgcgaggcaccggatgccatcgacaccctgctgctgcaaccgtggcagctggtgaaaagcaaaaaagtggtgcaggagatgtggaatcagcccgccaccgaggttgccattcccgtcgggctggcaggcacagacgaactgttgatggcgattagccagttaaccggcaaagccattcccgattcgctggcgctggagcgcgggcggctggtcgatatgatgctcgactcccacacctggttacacggtaaaaaattcggtctgtttggcgatccggattttgtcatgggattgacccgcttcctgctggaactgggctgtgaacctgccgtcatcctctgccataacggtaacaaacgctggcaaaaagcgatgaagaaaatgctcgatgcttcaccgtacggccaggagagcgaagtgtttatcaactgcgacttgtggcatttccgctcgctgatgttcacccgccagccggattttatgattggcaactcgtacgccaagtttattcagcgcgacaccttagccaagggcgaacagtttgaagtcccgctgatccgcctcggttttccgctgttcgaccgtcaccatctgcaccgccagaccacctggggctacgagggcgcgatgagcattctcacgacgctggtgaatgcggtactggagaaagtggacaaagagaccatcaagctcggcaaaaccgactacagcttcgatcttatccgttaa

SEQ ID NO: 142 - DNA, 1386 bp, Kosakonia pseudosacchari
  gene 1..1386: note = nifK2
  source 1..1386: mol_type = genomic DNA
atggctgatattgttcgtagtaaaaaaccgctggcggtgagcccgataaaaagcggccagccgctgggggcgatcctggcaagcctgggtttcgaacagtgcataccgctggtacacggcgctcaggggtgcagcgcgttcgcgaaagtgttctttattcaacattttcacgacccgatcccgctgcaatcgacggcgatggacccgacttccaccattatgggcgccgatgaaaacatttttaccgcgctcaatgttctctgccagcgcaacgccgcgaaagccatcgtgctgctcagcaccgggctgtcagaagcccagggcagcgatatttcacgagtggtgcgccagtttcgtgatgactttccgcggcataaaaacgtggcgctgctcaccgtcaacaccccggatttctacggctcgctggaaaacggctacagcgccgtgctggaaagcatgattgaacagtgggtgcccgcgcagcccgccgccagcctgcgcaaccgtcgcgtcaacctgctggtcagccatttactgacgccgggcgatatcgaactgttacgcagttatgtggaagcattcggtctgcaaccggtgattgtgccggatctatcgcagtcgctggacggacatctggccaacggtgatttttcgcccgtcacccaggggggaacaccgctgcgcatgattgaacagatggggcaaaacctggccacttttgtgattggccactcgctggggcgggcggcggcgttactggcgcagcgcagccgtggcgaggtgatcgccctgccgcatctgatgacgcttgatgcgtgcgacacctttatccatcgcctgaaaaccctctccgggcgcgacgtgcccgcgtggattgagcgccagcgcgggcaagtgcaggatgcgatgatcgattgccatatgtggttgcagggcgcggctatcgccatggccgcagaaggcgatcacctggcggcatggtgcgatttcgcccgcagccagggcatgatccccggcccggttgtcgcgccggtcagccagccggggttgcaaaatctgccggttgaaatggtggtcatcggcgatctggaagatatgcaggatcggctttgcgcgacgcccgccgcgttactggtggccaattctcatgccgccgatctcgccacgcagtttgatatgtcgcttatccgcgccgggtttccggtgtatgaccggctgggggaatttcgtcggctgcgccaggggtatagcggcattcgtgacacgctgtttgagctggcgaatgtgatgcgcgaacgccattgcccgcttgcaacctaccgctcgccgctgcgtcagcgcttcggcgacaacgttacgccaggagatcggtatgccgcatgttaa

SEQ ID NO: 143 - DNA, 1488 bp, Kosakonia pseudosacchari
  gene 1..1488: note = nifL
  source 1..1488: mol_type = genomic DNA
atgaccctgaatatgatgatggatgccagcgcgcccgaggccatcgccggtgcgctttcgcaacaacatcctgggctgttttttaccatcgttgaagaagcccccgtcgctatttcactaaccgatgccgaggcacgtattgtctatgccaacccggcattctgccgccagaccggctatgagcttgaggagttgttgcagcaaaatccccgcctgcttgccagtcagcagaccccacgggaaatctaccaggatatgtggcacaccctgttacaacgtcgaccatggcgcgggcaattgatcaaccgccaccgtgacggcagcctttttctggttgagatcgatatcaccccggtgattaacccgtttggcgaactggaacactacctggccatgcagcgcgatatcagcgccggttatgcgctggagcagcggttgcgtaatcacatggcgctgaccgaagcggtgctgaataacattccggcggcggtggtcgtggtcgatgaacgcgatcgtgtggttatggataacctcgcctataaaactttctgtgctgattgcggcggaaaagagctactgagcgaactccatttttcagcccgtaaagcggagctggcaaacggccaggtcttaccggtggtgctgcgcggcgcggtgcgctggttgtcggtcacctgctgggcgctgccaggcgtcagcgaagaagccagtcgctactttattgataataccttgacgcgcacgctggtggtcatcaccgacgacacccagcagcgccagcagcaagagcaaggacggcttgaccgccttaaacagcagatgaccagcggcaaactgctggcggcgatccgcgaagcgcttgacgccgcgctgatccagcttaactgccccatcaatatgctggcggcggcgcggcgtttaaacggcagtgataacagcaacgtagcgctggacgccgcgtggcgcgaaggtgaagaagcgatggcgcggctgaaacggtgccgcccgtcgctggagctggaaagtgccgccgtctggccgctgcaacccttttttgacgacttgcgcgcgctttatcacacccgctacgagcagggtaaaaatttgcaggtcacgctggattcgacgcatctggtgggatttggtcagcgaacccaactgctggcctgcctgagtctgtggctcgatcgcacgctggatattgccgtcgggctgcgtgatttcaccgcccaaacgcagatttacgcccgggaagaagcgggctggctctcgttgtatatcactgacaatgtgccgttgattccgctgcgccatacccattcgccggatgcgcttaacgcaccgggaaaaggtatggagttgcggctgatccagacgctggtagcgcatcacaacggcgcgatagaactcacttcacgccccgaagggggaagctgcctgaccctacgattcccgctatttcattcactgaccggaggttcaaaatga

SEQ ID NO: 144 - DNA, 1575 bp, Kosakonia pseudosacchari
  gene 1..1575: note = nifA
  source 1..1575: mol_type = genomic DNA
atgacccagcgaaccgagtcgggtaataccgtctggcgcttcgatttatcccagcagttcaccgcgatgcagcggataagcgtggttctcagccgggcgaccgaggttgaacagacactccagcaggtgctgtgcgtattgcacaatgacgcctttttgcagcacggcatgatctgtctgtacgacagccagcaggcgattttgactattgaagcgttgcaggaagccgatcagcagttgatccccggcagctcgcaaattcgctaccgtccgggtgaagggctggtcgggacggtgctttcgcaggggcaatcgttagtgctggcgcgtgtggctgacgatcagcgctttcttgaccgcctgggactgtatgattacaacctgccgtttatcgccgtgccgctgatagggccggatgcgcagacttttggcgtgctgacggcgcaaccgatggcgcgttacgaagagcggttacccgcctgcacccgctttctggaaacggtcgcgaatctggtggcgcagaccgtgcgtttgatgacgccgccggctgcacgcccttccccacgcgctgccatcacgccaaccgccagcccgaaatcgtgcagtacttcacgcgcgttcggcttcgaaaatatggtcggcaacagcccggcaatgcgccagaccatggagattatccgtcaggtttcgcgctgggataccaccgttctggtgcgcggcgagagcggcaccggcaaggaactgattgccaacgccatccatcacaattcgccgcgcgccagtgcgccatttgtgaaattcaactgtgcggcgctgccggacacattgcttgaaagcgaattatttggtcatgaaaaaggcgcctttaccggcgcggtacgccagcgtaaaggccgttttgagctggccgatggcggcacgctgtttcttgacgaaattggggaaagcagcgcctcgtttcaggctaagctgctgcgtattttgcaggagggcgaaatggaacgcgtcggtggtgacgagacattgcaagtgaatgtgcgcatcattgccgcgacgaaccgcaaccttgaagatgaagtacgcctgggacattttcgcgaagatctctattaccgcctgaatgtgatgcccatcgccctgccgccgctgcgcgaacgccaggacgacatcgccgaactggcacattttctggtgcgtaaaatcgcccacaaccagaaccgcacgctgcgcattagcgagggcgctatccgcctgctgatgagctacagctggcccggcaatgtgcgcgaactggaaaactgccttgagcgctctgcggtgatgtcggaaaacggtctgatcgatcgggacgtgattttatttaatcatcgcgaccagccagccaaaccgccggttatcagcgtcacgcccgacgataactggctcgataacacccttgacgagcgccagcggctgattgccgcgctggaaaaagcgggatgggtacaagccaaagccgcccgcttgctggggatgacgccgcgccaggtcgcttatcgtattcagaccatggatatcaccctgccaaggctataa

SEQ ID NO: 145 - DNA, 2850 bp, Kosakonia pseudosacchari
  gene 1..2850: note = glnE
  source 1..2850: mol_type = genomic DNA
atgccgcaccacgcaggattgtcgcagcactggcaaacggttttttctcgtctgccggaagcgctcaccgcgcaaccattgagcgcgcaggcgcagtcagtgctcacttttagtgattttgttcaggacagcatcatcgtgcatcctgagtggctggcagagcttgaaagcgcaccgccgccagcgaacgagtggcaacactacgcgcaatggctgcaagcggcgctggagggcgtcaccgatgaaacctcgctgatgcgcacgctgcggctgtttcgccgtcgcattatggtgcgcatcgcctggagtcaggcgctacagttggtggcggaagaggatatcctgcaacagctcagcgtgctggcggaaactctgatcgtcgccgcgcgcgactggctctatgacgcctgctgccgtgagtggggaacgccgtgcaatccgcaaggcgtcgcgcagccgatgctggtgctcggcatgggcaaacttggcggcggcgaactcaatttctcatccgatatcgatttgatttttgcctggccggaaaatggcaccacgcgcggcggacgccgtgaactggataacgcgcagttttttacccgccttggtcaacggctaattaaagtcctcgaccagcccacgcaggatggctttgtctaccgcgtcgatatgcgcttgcgtccctttggcgacagcggcccgctggtgctgagttttgccgcgctggaagattactaccaggagcaggggcgcgactgggaacgatacgcgatggtgaaagcgcgcattatgggggacaacgacggcgaccatgcgcgagagttgcgcgccatgctgcgcccgttcgttttccgccgctatatcgacttcagcgtgatccagtctctgcgcaacatgaaaggcatgattgcccgcgaagtgcggcgtcgcggcctgaaggacaacataaaactcggcgcgggcggtattcgcgaaatagagtttatcgtgcaggttttccagttgattcgcggcggtcgcgagcctgcgctgcaatcgcgttcgctgttgccgacgcttgctgccattgatcaactacatctgctgccggatggtgatgcaccccggctgcgcgaggcgtatttgtggctgcgacggctggaaaacttgctgcaaagcattaatgacgaacagacacagacgctgccggccgatgatttgaatcgcgcgcgcctcgcctggggaatgggcaaagagagctgggaagcgctctgcgaaacgctggaagcgcatatgtcggcggtgcggcagattttcaacgatctgattggcgatgatgaaacggattcgccggaagatgcgctttctgagggctggcgcgaattgtggcaggatgcgttgcaggaagaggactctacgcccgtgctggcgcatctttccgaggacgatcgccgccgcgtggtggcgctgattgctgattttcgcaaagagctggataaacgcaccattggcccgcgcgggcgacaggtactcgatcacttaatgccgcatctgctcagcgatgtatgctcgcgtgacgatgcgccagtgccgctgtcgcgtctgacgccgctgctcaccggtattattacgcgcaccacttaccttgagctgctgagtgaattccccggtgcgctgaaacacctcatttccctgtgcgccgcgtcgccgatggtggccagccaactggcgcgctacccgatcctgctcgatgaactgctcgacccgaacacgctctatcaaccgacggcgatgaacgcctatcgcgatgaactgcgacaatacctgttgcgcgtgccggaagaggatgaagagcagcaactggaggcgctacggcagtttaagcaggcgcagttgttgcgcgtagcggcggcggatatcgccggtacgttacccgtcatgaaagtgagcgatcacttaacctggctggcggaagcgattatcgatgcggtggtgcagcaagcctggaaccagatggtggcgcgttacggccagccgacgcatctgcacgatcgcgaagggcgcggtttcgccgtggtcggttacggcaaacttggcggctgggaattaggttacagctccgatctggatctggtgttcctgcacgactgccccatggatgtgatgaccgatggcgagcgtgaaatcgatggccgccagttctatttgcgcctcgcgcagcgcgtgatgcacctgttcagcacgcgcacgtcgtccggcattctttatgaagtcgatgcgcgtttgcgcccgtccggcgcggccggaatgctggtgaccactgcggaagcgttcgccgattatcaaaaaaatgaagcctggacatgggagcatcaggcgctggcgcgtgcgcgcgtggtgtacggcgatccgcaactgaccgccgaatttgacgccattcgccgcgatatcctgatgacctcccgcgatgccgctaccctgcaaaccgaagtgcgggaaatgcgtgagaaaatgcgcgcccatcttggtaacaagcacaaagaccgtttcgatctgaaagccgatgaaggcggtatcaccgatattgagtttatcgctcagtatctggtgctgcgctttgcccatgagaagccgaaactgacgcgctggtcggataatgtgcgcatcctcgaagggctggcgcaaaacggcatcatggatgagcaggaagcgcaggcattgacgctggcgtacaccacgttgcgtgatgagctgcaccacctggcgctgcaagagctgccaggacatgtggcgctctcctgttttgtcgccgagcgtgcgcttatcaaaaccagctgggacaagtggctggtggaaccgtgcgccccggcgtaa

SEQ ID NO: 146 - DNA, 1287 bp, Kosakonia pseudosacchari
  gene 1..1287: note = amtB
  source 1..1287: mol_type = genomic DNA
atgaaaaacacaacattaaaaacggctcttgcttcgctggcgttgctgccaggcctggcgatggcggctcccgctgtggcggataaagccgacaacggctttatgatgatttgcaccgcgctggtgctgtttatgaccattccgggcattgcgctgttctacggcggtttgatccgcggtaaaaacgtgctgtcgatgctgacgcaggttgccgtcaccttcgctctggtgtgcatcctgtgggtggtttacggctactctctggcatttggcgagggcaacagcttcttcggcagtttcaactgggcgatgttgaaaaacatcgaattgaaagccgtgatgggcagcatttatcagtacatccacgtggcgttccagggctcctttgcttgtatcaccgttggcctgattgtcggtgcgctggctgagcgtattcgcttctctgcggtgctgatttttgtggtggtatggctgacgctttcttatgtgccgattgcgcacatggtctggggtggcggtctgctggcaacccacggcgcgctggatttcgcgggcggtacggttgttcacatcaacgccgcgatcgcaggtctggtgggggcttacctgattggcaaacgcgtgggctttggcaaagaagcgttcaaaccgcataacctgccgatggtcttcaccggcaccgcgatcctctatgttggctggtttggcttcaacgccggctctgcaagctcggcgaacgaaatcgctgcgctggctttcgtgaacacggttgttgccactgcggccgctattctggcgtgggtatttggcgagtgggcaatgcgcggtaagccgtctctgctcggtgcctgttctggtgccatcgcgggtctggttggtatcaccccggcgtgcggttatgtgggtgtcggcggcgcgctgattgtgggtctgattgccggtctggcagggctgtggggcgttactgcactgaaacgtatgttgcgtgttgatgacccatgcgatgtcttcggtgtgcacggcgtgtgcggcatcgtgggttgtatcctgaccggtatcttcgcgtctacgtcgctgggcggtgtcggtttcgctgaaggggtgaccatgggccatcaggtactggtacagctggaaagcgttgccatcactatcgtgtggtctggcgtggtggcctttatcggttacaaactggcggatatgacggtaggcctgcgcgtaccggaagagcaagagcgtgaagggctggatgtgaacagccacggcgaaaatgcgtataacgcctga

SEQ ID NO: 147 - DNA, 500 bp, Kosakonia pseudosacchari
  gene 1..500: note = PinfC
  source 1..500: mol_type = genomic DNA
ttcttggttctctggagcgctttatcggcatcctgactgaagaatttgcaggcttcttcccaacctggcttgcacccgtgcaggtagttgtgatgaacatcactgattcgcaggctgaatacgttaacgaattgacccgtaaactgcaaaatgcgggcattcgtgtaaaagcagacttgagaaacgagaagattggctttaaaatccgcgagcacactttacgtcgtgtcccttatatgctggtttgtggtgacaaagaggtcgaagccggcaaagttgctgtgcgtacccgtcgcggtaaagacctgggtagcctggacgtaaatgatgttatcgagaagctgcaacaagagattcgcagccgcagtcttcaacaactggaggaataaggtattaaaggcggaaaacgagttcaaacggcgcgtcccaatcgtattaatggcgagattcgcgccacggaagttcgcttaacaggtctggaaggcgagcagcttggtatt

SEQ ID NO: 148 - DNA, 348 bp, Kosakonia pseudosacchari
  gene 1..348: note = Prm1
  source 1..348: mol_type = genomic DNA
cgttctgtaataataaccggacaattcggactgattaaaaaagcgccctcgcggcgctttttttatattctcgactccatttaaaataaaaaatccaatcggatttcactatttaaactggccattatctaagatgaatccgatggaagctcgctgttttaacacgcgttttttaaccttttattgaaagtcggtgcttctttgagcgaacgatcaaatttaagtggattcccatcaaaaaaatattctcaacctaaaaaagtttgtgtaatacttgtaacgctacatggagattaactcaatctagagggtattaataatgaatcgtactaaactggtactgggcgc

SEQ ID NO: 149 - DNA, 339 bp, Kosakonia pseudosacchari
  gene 1..339: note = Prm7
  source 1..339: mol_type = genomic DNA
cgcgtcaggttgaacgtaaaaaagtcggtctgcgcaaagcacgtcgtcgtccgcagttctccaaacgttaattggtttctgcttcggcagaacgattggcgaaaaaacccggtgcgaaccgggtttttttatggataaagatcgtgttatccacagcaatccattgattatctcttctttttcagcatttccagaatcccctcaccacaaagcccgcaaaatctggtaaactatcatccaattttctgcccaaatggctgggattgttcattttttgtttgccttacaacgagagtgacagtacgcgcgggtagttaactcaacatctgaccggtcgat

SEQ ID NO: 150 - DNA, 1538 bp, unidentified
  misc_feature 1..1538: note = Enterobacter sp.
  gene 1..1538: note = 16S
  variation 62: note = n is a, c, t, g, unknown or other
  variation 265: note = n is a, c, t, g, unknown or other
  variation 457: note = n is a, c, t, g, unknown or other
  variation 469: note = n is a, c, t, g, unknown or other
  variation 539: note = n is a, c, t, g, unknown or other
  variation 551..552: note = n is a, c, t, g, unknown or other
  variation 559: note = n is a, c, t, g, unknown or other
  variation 561: note = n is a, c, t, g, unknown or other
  variation 576: note = n is a, c, t, g, unknown or other
  variation 587: note = n is a, c, t, g, unknown or other
  variation 591: note = n is a, c, t, g, unknown or other
  variation 655..657: note = n is a, c, t, g, unknown or other
  variation 665: note = n is a, c, t, g, unknown or other
  variation 678: note = n is a, c, t, g, unknown or other
  variation 706: note = n is a, c, t, g, unknown or other
  variation 710: note = n is a, c, t, g, unknown or other
  variation 714: note = n is a, c, t, g, unknown or other
  variation 718: note = n is a, c, t, g, unknown or other
  variation 735: note = n is a, c, t, g, unknown or other
  variation 755: note = n is a, c, t, g, unknown or other
  variation 759: note = n is a, c, t, g, unknown or other
  variation 796: note = n is a, c, t, g, unknown or other
  variation 1006..1007: note = n is a, c, t, g, unknown or other
  variation 1016..1017: note = n is a, c, t, g, unknown or other
  variation 1133: note = n is a, c, t, g, unknown or other
  source 1..1538: mol_type = genomic DNA
ttgaagagtttgatcatggctcagattgaacgctggcggcaggcctaacacatgcaagtcgngcggaagcacaggagagcttgctctctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggcncacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgnggttaataaccncagcaattgacgttacccgcagaagaagcaccggctaactccgtgccagcagccgcggtaatacggaggntgcaagcgttanncggaatnantgggcgtaaagcgtncgcaggcggtntgtnaagtcggatgtgaaatccccgggctcaacctgggaactgcattcgaaactggcaggctagagtnnngtagaggngggtagaattccnggtgtagcggtgaaatgcgtagagatcnggangaanaccngtggcgaaggcggcccnctggacaaagactgacgctnaggngcgaaagcgtggggagcaaacaggattagataccctngtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttnncagagatgnnttggtgccttcgggaactctgagacaggtgctgcatggctgtcgtcagctcgtgttgtgaaatgttgggttaagtcccgcaacgagcgcaacccttatcctttgttgccagcggtncggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 151 - DNA, 882 bp, unidentified
  misc_feature 1..882: note = Enterobacter sp.
  gene 1..882: note = nifH
  source 1..882: mol_type = genomic DNA
atgaccatgcgtcaatgtgccatttacggcaaaggtggtatcggtaaatccactaccacgcaaaacctggtcgccgcgctggcggagatgggcaagaaagtaatgatcgtcggctgcgacccgaaagcagactccactcgtctgatcctgcatgcgaaagcgcagaacaccattatggagatggcggctgaagtcggctccgtggaagaccttgaactggaagatgtgctgcaaatcggttacggcgacgtacgctgcgcagaatccggcggcccggaaccaggcgttggctgtgctggtcgcggggtaattaccgccatcaacttcctggaagaagaaggcgcctatgttcccgacctcgatttcgtcttttacgacgtgttgggcgacgtggtgtgcggggggttcgccatgccgattcgcgaaaacaaagcgcaggagatctacatcgtctgctccggcgaaatgatggcgatgtacgccgccaacaacatctctaaaggcatcgtgaaatacgccaaatccggcaaagtgcgccttggcgggctgatctgtaactcccgtcagaccgaccgcgaagatgagctgatcatagcgctggcggaaaaactcggcacccagatgatccacttcgtgccgcgcgacaacatcgtgcaacgcgctgaaatccgccgtatgacggtgattgagtacgatccgaaatgcaaccaggccaatgaataccgcacgctggcgaacaagatcgtcaacaacaccaaaatggtcgtgccaacgcccatcaccatggacgaactggaagagctgttgatggaattcggcattatggatgtggaagacaccagcattatcggtaaaaccgccgcagaagaaaacgcggtttga

SEQ ID NO: 152 - DNA, 1449 bp, unidentified
  misc_feature 1..1449: note = Enterobacter sp.
  gene 1..1449: note = nifD1
  source 1..1449: mol_type = genomic DNA
atgagcaatgcaacaggcgaacgtaatctggagatcatccaggaagtgctggagatctttccggaaaaaacgcgcaaagaacgcagaaagcacatgatggtgagcgacccggagatggaaagcgtcgggaaatgcatcatctccaaccgtaagtcgcagcccggcgtaatgaccgtgcgcggttgctcttacgccggttctaaaggggtggtattcgggccgatcaaagatatggcccatatttcccacggcccggtcggctgcggtcagtactcccgcgccgggcggcgtaactactacaccggcgtcagcggtgtggatagcttcggtacgctcaactttacctccgattttcaggagcgcgatatcgtgtttggcggcgataaaaagctgaccaaactgattgaagagatggagacgctgttcccgctgaccaaagggatctccattcagtccgaatgcccggtcggcctgattggcgacgacattgaagccgttgccaacgccagccgcaaagccatcaataaaccggtcattccggtgcgctgcgaaggttttcgcggcgtttcccagtcactcggtcaccacattgccaacgacgtgatccgcgactgggtactggataaccgcgaaggcaagccgtttgaggccggtccttatgacgtggcgatcatcggcgattacaacatcggcggcgatgcctgggcgtcgcgcattttgctcgaagagatgggcctgcgcgtggtggcgcagtggtccggcgacggcacgctggttgagatggagaacacgccgttcgtcaaactcaaccttgtgcactgctaccgctcaatgaactatatctcccgccatatggaggagaaacacggtattccgtggatggagtacaacttcttcggtccgaccaaagtcgccgaatcgttgcgcaaaatcgccgatatgtttgatgacaccattcgcgccaacgccgaagcggtgatcgccaaatatcaggcgcagaacgacgccatcatcgccaaataccgtccgcgtctggaaggccgcaaagtgctgctgtatatgggcggtttacgtcctcgccatgtgattggcgcttatgaagatctggggatggaaattatcgctgcgggttatgaattcgcccacaacgatgactacgaccgcaccctgccggatctgaaagaaggcaccttgctgttcgacgatgccagcagttatgaactggaagcctttgtcaaagcgctgaagccggatctgatcggctccggcattaaagagaagtacatcttccagaaaatgggcgtgccgtttcgccagatgcactcctgggattactccggcccctatcacggttatgacggctttgccatcttcgcccgcgatatggatatgacgatcaacaaccccgcgtggggccagttgaccgcgccgtggctgaaatccgcctga

SEQ ID NO: 153 - DNA, 1092 bp, unidentified
  misc_feature 1..1092: note = Enterobacter sp.
  gene 1..1092: note = nifD2
  variation 709: note = n is a, c, t, g, unknown or other
  source 1..1092: mol_type = genomic DNA
atgggacgcggcgagcgccgcctgttccatgccgtgcgccacatcgtcaaccgctaccacccggccgccgtctttatctataacacctgcgttcccgcgatggagggcgacgatatcgaagccgtctgccaggcggcagaaaccgccatcggcgtaccggtgattgccgttgatgtcgccgggttttacggcagcaaaaatctcggcaaccggttggccggtgaagtgatggtgaaaaaggtgattggcgggcgtgaacccgcgccgtggccggaagataccccttttgccccggcgcaccgccacgatatcgggctgattggcgaattcaatattgccggagagttctggcatattcagccgctgctcgatgagctgggtattcgcgtgctcggcagcctctccggcgacgggcgcttcagtgaaatccagacgctgcaccgggcgcaggtcaatatgctggtctgctccagggcgctgatcaacgtcgcccgctcgctggagcagcgctacggcacgccgtggtttgaaggcagtttttatggtgttcgcgccacctctgacgccctgcgccaactggcggcgctgaccggagaccgcgatctgatgcagcgcaccgaacagctcattgcccgcgaagagcagcaaacagagcaggcgctggccccgctgcgcgagcgcctgcgcgggcgcaaagcgctgctctatnccggcggcgtgaaatcctggtcggtggtttcggcgcttcaggatctgggcatggaagtggtggcgaccggcacgcgcaaatccaccgaagaggataaacagcgcatccgcgaactgatgggcgccgacgcgctgatgcttgatgaaggtaacgcccgctcgctgctggacgtggtttaccgctacaaggcggacatgatgatcgccgggggacgcaatatgtacaccgcctacaaagcgcggctgccgttcctcgatatcaatcaggagcgcgagcacgcctttgccggctaccgcggcattgtcaccctggccgaacagctctgcctgaccatggaaagcccggtctggccgcaaacccattcccgcgcaccgtggcaataa

SEQ ID NO: 154 - DNA, 846 bp, unidentified
  misc_feature 1..846: note = Enterobacter sp.
  gene 1..846: note = nifK
  source 1..846: mol_type = genomic DNA
atgatggagcaaatggacgtgccgtgcagcctgctttccgatccctccgaagtgctggataccccggctgacgggcattaccacatgtatgcgggcggtacgacccagcaggagatgcgcgaagcgcctgacgctatcgacaccctgctgctgcaaccctggcaactggtgaaaaccaaaaaagtggtgcaggaaagctggaaccagcccgctaccgaggtgcaaatcccaatggggctggccggaaccgacgagctgctgatgacggtaagccagttaaccggcaaagccattccggatagcttagcgctggaacgcggtcggctggtggatatgatgctcgactcccacacctggctgcacggcaagaaattcggcctgttcggtgacccggattttgtcatggggctgacccgcttcctgctggaactgggctgcgaaccgacggtgattctgtgccataacggcagcaagcgctggcagaaagcgatgaagaaaatgcttgaagcctcgccgtacgggaaagagagcgaagtctttatcaactgcgatttgtggcatttccgctcgctgatgtttacccgtcagccggactttatgatcggcaactcctacgccaagtttatccagcgcgatacgctggcgaagggtgagcagtttgaagtgccgctgatccgcctggggttcccgctgttcgatcgccaccatctgcaccgccagaccacctggggttacgaaggggccatgagtatcctcaccacgctggttaatgcggtgctggagaaagtcgacagagagaccatcaagctcggcaaaaccgactacagcttcgatcttatccgttaa

SEQ ID NO: 155 - DNA, 1095 bp, unidentified
  misc_feature 1..1095: note = Enterobacter sp.
  gene 1..1095: note = nifL
  variation 942: note = n is a, c, t, g, unknown or other
  source 1..1095: mol_type = genomic DNA
atgcagcgcgacatcagcaccagctacgcgctggaacaacggctgcgcaatcatatgacgctgaccgaagccgtcttgaataacattccggcggcggttgtagtggtggatgaacgcgatcgggtggtgatggataacctcgcctacaaaaccttttgcgccgattgcggcggtaaagaactactcaccgaaatcaacttttccgcccataaggcggagctggcgcagggcctggtactgccggtagtgctgcgcggcaccgtgcgctggttgtccgttacctgttgggcgctgccgggcgtcagcgaagaagcaggccgctactttattgatagcgccgtgccgcgcacgctggtggtgatcaccgataatactcagcagcagcaacaacaggagcaggggcgtcttgatcgtctgaagcagcagataaccagcggtaaattgctggcggcgatccgcgaatcgctggacgccgcgctggtacaactcaattgcccaattaatatgctggccgccgcacgccgcttaaatggcgacgagcatagcaatctggcgctggatgccgcatggcgtgaaggcgaagaagcgatggcgcggttgcagcgctgccgcccgtcgctggaactggaaagcccggcagtctggccgctccagccgttccttgacgatctgcgtgccctgtatcacacccgatataaccagggcgaaaacctgcaaattgagctggaatcccccgacctggtgggctttggccagcgaacacaactgcttgcctgcctgagcctgtggctcgacagaaccctggatattgccgcggagctacgtgatttcacggtacagactcaactttacgcccgcgaagagagcggctggctgtcgttctatttaaacgacaatgtgccgctgattcaggtgcgctacacccattcacccgatgcactnaatgcgcccggtaaaggcatggagctgcggctgatccagacgctggtcgcccaccatcgaggcgcaatagaactgacctcacgccctcagggaggcacctgtctgatcctgcgtttcccattattttactcgctgacaggaggctcactatga

SEQ ID NO: 156 - DNA, 219 bp, unidentified
  misc_feature 1..219: note = Enterobacter sp.
  gene 1..219: note = nifA partial gene
  source 1..219: mol_type = genomic DNA
atgactcagcgaaccgagtcgggtacaaccgtctggcgctttgacctctcccaacagtttacagccatgcagcgtatcagtgtggtgttaagccgcgcgacggagatcgggcagacgctacaggaagtgctgtgcgtgctgcacaacgatgcctttatgcagcacgggatgatctgtccgtacgcgcgggtgcgcgtcttcgcgagcgtatggctttga

SEQ ID NO: 157 - DNA, 1635 bp, unidentified
  misc_feature 1..1635: note = Enterobacter sp.
  gene 1..1635: note = glnE
  variation 234: note = n is a, c, t, g, unknown or other
  variation 274: note = n is a, c, t, g, unknown or other
  variation 1535: note = n is a, c, t, g, unknown or other
  source 1..1635: mol_type = genomic DNA
atgcgcgtggaagactggtcaacgctgaccgaacggctcgatgcccatatggcaggcgtgcgccgaatctttaacgaactgatcggtgatgacgaaagtgagtcgcaggacgatgcgctctccgagcactggcgcgagctgtggcaggacgcgcttcaggaagatgacaccacgccggtgctgacgcacttaaccgacgacgcgcgccatcgcgtggtggcgctgatcgctganttccgtcttgagctgaacaaacgcgccatcggcccgcgtngtcgccaggtgctggatcacctgatgccgcacctgctgagcgaagtctgctcgcgtgccgatgcgccggtgccgctgtcgcggatgatgcccctgctgagcgggattatcacccgtactacctaccttgaactcctgagcgagttccctggcgcgcttaagcacctgatttcactctgcgccgcgtcgccgatggtggccaacaagctggcgcgttacccgctgctgctggatgagctgctcgatccgaataccctttatcaaccgacggcgaccgacgcctaccgggacgaactgcgtcagtatctgctgcgcgtgccggaagaagacgaagagcaacagctggaggcgctgcgtcagtttaagcaggcccagatgctgcgcgtggcggccgcagatattgccggaacgctgccggtgatgaaagtgagcgatcacttaacctggcttgcggaagcgattatcgacgcggtggtgcatcaggcctgggtgcagatggtggcgcgctatggccagccgaaacatctggctgaccgtgatggtcgcggcttcgcggtggtgggttacggtaagctcggcggttgggagctgggctatagctccgatctggatttaatcttcctccacgactgcccggttgatgtgatgaccgacggcgagcgcgagattgacgggcgtcagttctacctgcgcctggcgcagcgcatcatgcacctgttcagcacccgcacctcgtcgggcattttgtatgaagtggatgcccgtctgcgcccgtccggcgcggcgggcatgctggtcacctcgacggagtccttcgctgattaccagaagaatgaagcctggacgtgggagcatcaggcgctggtgcgcgcccgtgtggtgtatggcgatccgctgctgaaaacgcagtttgacgtgattcgtaaggaagtcatgaccaccgtgcgcgatggcagcacgctgcaaacggaagtgcgcgaaatgcgcgagaaaatgcgcgcgcacttaggcaataaacatcgcgatcgctttgatattaaagccgatgagggcggtattaccgatattgagtttattacccagtatctggtgttgctgcacgcgcatgacaagccgaagctgacgcgctggtcggataacgtgcgcattctggaactgctggcgcaaaacgacattatggacgagcaggaggcgcaggccttaacccgtgcctatacaacgcttcgcgatgagctccatcatctggcgttgcaggagcagcngggacacgtggcgctggactgtttcaccgctgaacgcgctcaggtaacggccagctggcagaagtggctggtggaaccgtgcgtaacaaatcaagtgtga

SEQ ID NO: 158 - DNA, 1316 bp, unidentified
  misc_feature 1..1316: note = Enterobacter sp.
  gene 1..1316: note = 16S
  variation 43: note = n is a, c, t, g, unknown or other
  variation 247: note = n is a, c, t, g, unknown or other
  variation 784..785: note = n is a, c, t, g, unknown or other
  variation 794..795: note = n is a, c, t, g, unknown or other
  source 1..1316: mol_type = genomic DNA
agatgtgcccagatgggattagctagtaggtggggtaacggcncacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccncagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttnncagagatgnnttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 159 - DNA, 882 bp, unidentified; identical to SEQ ID NO: 151
  misc_feature 1..882: note = Enterobacter sp.
  gene 1..882: note = nifH
  source 1..882: mol_type = genomic DNA

SEQ ID NO: 160 - DNA, 1449 bp, unidentified; identical to SEQ ID NO: 152
  misc_feature 1..1449: note = Enterobacter sp.
  gene 1..1449: note = nifD1
  source 1..1449: mol_type = genomic DNA

SEQ ID NO: 161 - DNA, 1374 bp, unidentified
  misc_feature 1..1374: note = Enterobacter sp.
  gene 1..1374: note = nifD2
  source 1..1374: mol_type = genomic DNA
atgaaggggaacgagatcctggctttgctcgatgaacctgcctgcgagcacaaccataaacagaaatccggctgcagcgcgccgaaacccggcgcgacagcgggcggctgcgcctttgacggtgcgcagatcaccctgctgccactctccgatgttgcccacctggtacacggccccattggttgtaccggtagctcatgggataaccgtggcagcttcagttccggcccgacgatcaaccggctgggttttaccaccgatctgagcgaacaggatgtgatcatgggacgcggcgagcgccgcctgttccatgccgtgcgccacatcgtcaaccgctaccacccggccgccgtctttatctataacacctgcgttcccgcgatggagggcgacgatatcgaagccgtctgccaggcggcagaaaccgccatcggcgtaccggtgattgccgttgatgtcgccgggttttacggcagcaaaaatctcggcaaccggttggccggtgaagtgatggtgaaaaaggtgattggcgggcgtgaacccgcgccgtggccggaagataccccttttgccccggcgcaccgccacgatatcgggctgattggcgaattcaatattgccggagagttctggcatattcagccgctgctcgatgagctgggtattcgcgtgctcggcagcctctccggcgacgggcgcttcagtgaaatccagacgctgcaccgggcgcaggtcaatatgctggtctgctccagggcgctgatcaacgtcgcccgctcgctggagcagcgctacggcacgccgtggtttgaaggcagtttttatggtgttcgcgccacctctgacgccctgcgccaactggcggcgctgaccggagaccgcgatctgatgcagcgcaccgaacagctcattgcccgcgaagagcagcaaacagagcaggcgctggccccgctgcgcgagcgcctgcgcgggcgcaaagcgctgctctataccggcggcgtgaaatcctggtcggtggtttcggcgcttcaggatctgggcatggaagtggtggcgaccggcacgcgcaaatccaccgaagaggataaacagcgcatccgcgaactgatgggcgccgacgcgctgatgcttgatgaaggtaacgcccgctcgctgctggacgtggtttaccgctacaaggcggacatgatgatcgccgggggacgcaatatgtacaccgcctacaaagcgcggctgccgttcctcgatatcaatcaggagcgcgagcacgcctttgccggctaccgcggcattgtcaccctggccgaacagctctgcctgaccatggaaagcccggtctggccgcaaacccattcccgcgcaccgtggcaataa

SEQ ID NO: 162 - DNA, 1563 bp, unidentified
  misc_feature 1..1563: note = Enterobacter sp.
  gene 1..1563: note = nifK1
  source 1..1563: mol_type = genomic DNA
atgagccaaagtgctgagaaaattcaaaactgtcatccgctgtttgaacaggatgcgtaccagatgctgtttaaagataaacggcaactggaagaggcccacgatccggcgcgcgtgcaggaggtctttcaatggaccaccaccgccgagtatgaagcgcttaactttcaacgcgaagcgctgactatcgatccggccaaagcctgccagccgctgggtgcggtactgtgctcgctgggctttgccaataccctgccctatgttcacggctcccaggggtgcgtggcctatttccgcacctattttaaccgtcactttaaagagccgattgcctgtgtttctgactcgatgacggaagatgcggcagtattcggcggcaacaacaacctgaacaccgggttgcagaacgccagcgccctctacaagccggaaatcattgccgtctccaccacctgtatggcggaggtcatcggcgacgacctgcaggcgtttattgctaacgccaaaaaagacggctttatcgacgcggcgatcccggtgccttacgcgcacacgccaagctttatcggcagccatatcaccggctgggacaatatgtttgagggcttcgcccgtacctttaccgccgattacagcggacaaccgggcaaattaccgcgtatcaatctggtcagcggatttgaaacctatctcggtaatttccgcgtgctgaaacgcatgatggagcaaatggacgtgccgtgcagcctgctttccgatccctccgaagtgctggataccccggctgacgggcattaccacatgtatgcgggcggtacgacccagcaggagatgcgcgaagcgcctgacgctatcgacaccctgctgctgcaaccctggcaactggtgaaaaccaaaaaagtggtgcaggaaagctggaaccagcccgctaccgaggtgcaaatcccaatggggctggccggaaccgacgagctgctgatgacggtaagccagttaaccggcaaagccattccggatagcttagcgctggaacgcggtcggctggtggatatgatgctcgactcccacacctggctgcacggcaagaaattcggcctgttcggtgacccggattttgtcatggggctgacccgcttcctgctggaactgggctgcgaaccgacggtgattctgtgccataacggcagcaagcgctggcagaaagcgatgaagaaaatgcttgaagcctcgccgtacgggaaagagagcgaagtctttatcaactgcgatttgtggcatttccgctcgctgatgtttacccgtcagccggactttatgatcggcaactcctacgccaagtttatccagcgcgatacgctggcgaagggtgagcagtttgaagtgccgctgatccgcctggggttcccgctgttcgatcgccaccatctgcaccgccagaccacctggggttacgaaggggccatgagtatcctcaccacgctggttaatgcggtgctggagaaagtcgacagagagaccatcaagctcggcaaaaccgactacagcttcgatcttatccgttaa

SEQ ID NO: 163 - DNA, 1386 bp, unidentified
  misc_feature 1..1386: note = Enterobacter sp.
  gene 1..1386: note = nifK2
  source 1..1386: mol_type = genomic DNA
atggcagaaattatccgtagtaaaaagccgctggccgtcagcccggtaaaaagtggccagccgctgggcgcgattctggcgagcatgggctttgaacagagcattccgctggttcatggcgctcaggggtgcagcgccttcgcgaaggtcttttttatccagcattttcacgatccgatcccgctgcaatcgacggcaatggacccgacatcgaccattatgggtgccgatgagaacatctttaccgcgctgaatgtgctgtgttcacgcaacaacccgaaagcgattgttctgctgagcactggcctttccgaggcgcagggcagcgatatttcgcgcgtggtgcgccagttccgcgatgaatatccgcgccataaaggggtggcgctgctgaccgtcaacacgccggatttttacggcagcctggaaaacggctacagcgcggtgctggagagcatggttgaacagtgggtgccggaaaaaccgcagccgggcgtgcgcaatcgccgcgtgaacctgctgctcagccatttgcttacgccgggcgacattgagctgctgcgaagttatgtcgaggcatttggcctgcagccggtgatggtgccggatctttcccagtcgctggatggccatctcgccagcggggatttctcgccaattacccagggcggcagcagcctgcggctgattgaacagatgggacagagtcttggcacgttcgccattggcgtatccctctcccgcgccgcgcaattgctggcgcagcgcagccatgcggaagtggtcaccctgccgcatctgatgaccatgagccagtgcgatacgtttattcatcaactgaagcgcctctccgggcgcgatgttccggcgtggatcgaacgccagcgcgggcaactgcaggatgcgatgatcgattgtcatatgtggttgcagggcgcgcctgtcgcgctggccgccgagggcgatctgctcgccgcctggtgcgatttcgcctgcgatatgggcatggtgcccggcccggtggtggcgccggtgagccagaaagggttgcaggatctgccggtcgaaaaagtcattatcggcgatctggaggatatgcaggatctgttgtgtgaaacgcctgcatcgctgctcgtctctaattctcacgccgctgatttggccgggcagttcgacattccgctggtgcgcgccggtttccccctgttcgaccgtctgggcgagtttcgccgcgtgcgccagggttacgccgggatgcgcgacaccttgtttgagctggcgaatgcgctgcgcgatcgccatcatcatcttgccgcttatcactcgccgctgcgccagcgtttttacgaacccgcatcttcgggaggtgactatgcaacatgttaa

SEQ ID NO: 164 - DNA, 1488 bp, unidentified
  misc_feature 1..1488: note = Enterobacter sp.
  gene 1..1488: note = nifL
  source 1..1488: mol_type = genomic DNA
atgaccctgaatatgatgatggacgccaccgcgcccgccgagatcgccggagcgctctcacaacagcatcccgggttgtttttcaccatggttgaacaggcgcccgtcgcgatttcactgaccgatgccgatgcccacattctctacgccaaccccgcgttttgtcgccagtcggggtatgaactggaagagttgttgcagcaaaacccgcgcctgcttgccagtaagcagacgccgcgtgaaatctaccaggaaatgtggcacaccctgctgcaacaccgtccgtggcgcggacaactgatcaaccgtcgccgcgacggcagcctgtttctggtggaaatcgacatcaccccactgtttgatgcgttcggcaaactcgaacattacctggccatgcagcgcgacatcagcaccagctacgcgctggaacaacggctgcgcaatcatatgacgctgaccgaagccgtcttgaataacattccggcggcggttgtagtggtggatgaacgcgatcgggtggtgatggataacctcgcctacaaaaccttttgcgccgattgcggcggtaaagaactactcaccgaaatcaacttttccgcccataaggcggagctggcgcagggcctggtactgccggtagtgctgcgcggcaccgtgcgctggttgtccgttacctgttgggcgctgccgggcgtcagcgaagaagcaggccgctactttattgatagcgccgtgccgcgcacgctggtggtgatcaccgataatactcagcagcagcaacaacaggagcaggggcgtcttgatcgtctgaagcagcagataaccagcggtaaattgctggcggcgatccgcgaatcgctggacgccgcgctggtacaactcaattgcccaattaatatgctggccgccgcacgccgcttaaatggcgacgagcatagcaatctggcgctggatgccgcatggcgtgaaggcgaagaagcgatggcgcggttgcagcgctgccgcccgtcgctggaactggaaagcccggcagtctggccgctccagccgttccttgacgatctgcgtgccctgtatcacacccgatataaccagggcgaaaacctgcaaattgagctggaatcccccgacctggtgggctttggccagcgaacacaactgcttgcctgcctgagcctgtggctcgacagaaccctggatattgccgcggagctacgtgatttcacggtacagactcaactttacgcccgcgaagagagcggctggctgtcgttctatttaaacgacaatgtgccgctgattcaggtgcgctacacccattcacccgatgcactcaatgcgcccggtaaaggcatggagctgcggctgatccagacgctggtcgcccaccatcgaggcgcaatagaactgacctcacgccctcagggaggcacctgtctgatcctgcgtttcccattattttactcgctgacaggaggctcactatga

SEQ ID NO: 165 - DNA, 1575 bp, unidentified
  misc_feature 1..1575: note = Enterobacter sp.
  gene 1..1575: note = nifA
  source 1..1575: mol_type = genomic DNA
atgactcagcgaaccgagtcgggtacaaccgtctggcgctttgacctctcccaacagtttacagccatgcagcgtatcagtgtggtgttaagccgcgcgacggagatcgggcagacgctacaggaagtgctgtgcgtgctgcacaacgatgcctttatgcagcacgggatgatctgtctgtacgacagtaagcaagcgatcctttccattgaagccttgcatgaggccgatcagcagttaattcccggcagttcacagattcgctaccgtccgggcgaagggctggtaggcacggtgctttcacagggacagtcgctggtactgccctgtgtctccgacgatcggcgttttctcgatcgcctgggattgtatgattacagcttgccgtttatcgccgtgccgctgatggggccaaactcgcagcctatcggcgtgctggccgcccagcctatggcgcgttacgaggagcggctgcccgcctgcacgcgttttcttgaaaccgtcgccaatctggtggcgcaaaccgttcgcctgatgacaccgcccagcgtcgcgtctccaccccgtgctgctgccgcgcagattgccagccagcgcgggtgcgcgtcttcgcgagcgtatggctttgaaaacatggtcggtaaaagcgcggctatgcgtcagacgctggaaattattcgccaggtatcacgctgggacaccaccgtgctggtgcgtggcgaaagcggaaccggtaaagagttgatagccaacgctatccaccacaattcaccgcgcgccgccgcgccgtttgtcaaattcaactgcgcggcgctgcccgatacgctgctggagagtgaactcttcggtcatgaaaaaggcgcgtttaccggcgcggtgcgccagcgcaaaggccgtttcgaactggcggatggcggtacgctgtttcttgatgagatcggcgaaagtagcgcctcgtttcaggcgaaattgctgcgtatcttgcaggaaggcgaaatggaacgcgtcggcggcgacgaaacgctgcgggtgaatgtacggatcattgccgccaccaaccgcaatctggaagaggaagtgcggctgggtaattttcgcgaagatctctactatcgccttaatgtgatgccgatctccctgcccccgctccgcgagcgtcaggaggacatcgtcgagctggcgcattttctggtgcgcaaaatcgcgcaaaaccagaaccgcacgctgcgcatcagcgatggcgcgatccgtttgttgatgagctatagctggcctggaaacgtgcgtgagctggaaaactgccttgagcgatcggcggtgatgtcggaaaacgggctgatcgatcgcgacgtgattttgtttcaccacagggaaaatctgccaaaaacgccacagaccagtgcgccgcgcgaagagagctggctcgatcagaacctcgatgagcgacaaagattgatcgccgcgctggagaaagccggttgggtacaggcaaaagccgcgcgcctgctgggaatgaccccgcgccaggtggcctatcgtattcagacgatggacattgccatgccgagattgtag

SEQ ID NO: 166 - DNA, 2856 bp, unidentified
  misc_feature 1..2856: note = Enterobacter sp.
  gene 1..2856: note = glnE
  source 1..2856: mol_type = genomic DNA
atgccgctttcttcgcagttacagcagcagtggcagaccgtttgcgaacgtctgcctgagtcattaccggcgtcatcgttaagcgagcaggcaaagagcgtgctcgtcttcagtgattttgtgcaggaaagtatcaccgccaacccgaactggctggcggaacttgagaacgcaccaccgcaggcagaagagtggcggcactatgctggctggctgcaaactgtactcgaagacgttacggatgaggccacgctgatgcgcgtcctgcgccagttccgtcgtcgggtgatggtgcgcattgcctgggctcaggcgctggaactggtgagcgaagagagtacgctgcagcagttaagcgagctggcgcaaacgttgattgtcgccgcgcgagactggctctatgccgcctgctgtaaagagtggggcacgccgtgcagcgaggaaggggttcctcagccgctgttgattctggggatgggaaagctgggcggctgcgagctgaacttctcctctgatatcgacctgatttttgcctggccggagaacggctccacgcgcggaggccgccgcgagctggacaacgcgcagttctttacccgtctcggccagcgcctgattaaagcgctggatcagcccacgcaggacggttttgtttaccgcgtggacatgcgcctgcgtccgtttggcgacagcgggccgctggtgctgagctttgcggcgctggaagattattaccaggagcaaggtcgcgactgggagcgttacgcgatggtcaaagcgcggatcatgggcgacagcgacgacgcttatgccaacgagctgcgcgccatgctgcgtccgttcgtgttccgtcgctatatcgacttcagcgtcatccagtccctgcgaaatatgaaagggatgattgcccgcgaggtgcgccgccgtgggctgaaagacaatatcaagctcggtgcgggcggcatccgcgaaatcgaatttatcgtccaggtcttccagcttattcgcggcggacgcgagccgtcgctgcagtcccgttccttattaccgacgctgagcgccattgcgcagctgcatctcctgccggacggcgacgcgcaaaccctgcgcgaggcctatcttttcctgcgtcgtctggaaaacctgctgcaaagcattaatgacgaacagacccaaaccctgccgggcgacgaccttaaccgggcgcgtctggcctggggaatgcgcgtggaagactggtcaacgctgaccgaacggctcgatgcccatatggcaggcgtgcgccgaatctttaacgaactgatcggtgatgacgaaagtgagtcgcaggacgatgcgctctccgagcactggcgcgagctgtggcaggacgcgcttcaggaagatgacaccacgccggtgctgacgcacttaaccgacgacgcgcgccatcgcgtggtggcgctgatcgctgatttccgtcttgagctgaacaaacgcgccatcggcccgcgtggtcgccaggtgctggatcacctgatgccgcacctgctgagcgaagtctgctcgcgtgccgatgcgccggtgccgctgtcgcggatgatgcccctgctgagcgggattatcacccgtactacctaccttgaactcctgagcgagttccctggcgcgcttaagcacctgatttcactctgcgccgcgtcgccgatggtggccaacaagctggcgcgttacccgctgctgctggatgagctgctcgatccgaataccctttatcaaccgacggcgaccgacgcctaccgggacgaactgcgtcagtatctgctgcgcgtgccggaagaagacgaagagcaacagctggaggcgctgcgtcagtttaagcaggcccagatgctgcgcgtggcggccgcagatattgccggaacgctgccggtgatgaaagtgagcgatcacttaacctggcttgcggaagcgattatcgacgcggtggtgcatcaggcctgggtgcagatggtggcgcgctatggccagccgaaacatctggctgaccgtgatggtcgcggcttcgcggtggtgggttacggtaagctcggcggttgggagctgggctatagctccgatctggatttaatcttcctccacgactgcccggttgatgtgatgaccgacggcgagcgcgagattgacgggcgtcagttctacctgcgcctggcgcagcgcatcatgcacctgttcagcacccgcacctcgtcgggcattttgtatgaagtggatgcccgtctgcgcccgtccggcgcggcgggcatgctggtcacctcgacggagtccttcgctgattaccagaagaatgaagcctggacgtgggagcatcaggcgctggtgcgcgcccgtgtggtgtatggcgatccgctgctgaaaacgcagtttgacgtgattcgtaaggaagtcatgaccaccgtgcgcgatggcagcacgctgcaaacggaagtgcgcgaaatgcgcgagaaaatgcgcgcgcacttaggcaataaacatcgcgatcgctttgatattaaagccgatgagggcggtattaccgatattgagtttattacccagtatctggtgttgctgcacgcgcatgacaagccgaagctgacgcgctggtcggataacgtgcgcattctggaactgctggcgcaaaacgacattatggacgagcaggaggcgcaggccttaacccgtgcctatacaacgcttcgcgatgagctccatcatctggcgttgcaggagcagccgggacacgtggcgctggactgtttcaccgctgaacgcgctcaggtaacggccagctggcagaagtggctggtggaaccgtgcgtaacaaatcaagtgtga

SEQ ID NO: 167 - DNA, 1290 bp, unidentified
  misc_feature 1..1290: note = Enterobacter sp.
  gene 1..1290: note = amtB
  source 1..1290: mol_type = genomic DNA
atgaagatagcaacacttaaaacgggtctgggttcgctggcactgctgccgggcctggcgctggctgctgcacctgcggtggcagacaaagccgataacgcctttatgatgatcagcaccgcgctggtgctgttcatgtccattccgggcattgcgctgttctatggcggcctgatccgtggcaaaaacgttctctccatgctgacgcaggttgccgtaacgttcgcgctggtctgcgtactgtgggtggtttacggttactcgctggctttcggcacgggcaacgcgttctttggtaacttcgactgggtgatgctgaaaaatattgaactgaccgcgctgatgggcagtttctaccagtatattcacgttgctttccagggctcgttcgcctgcattaccgtcgggctgattgtaggcgcgcttgccgagcgtattcgtttctctgcggtcctgatcttcgtggtggtctggctgacgctctcctatgtgccgattgcgcacatggtctggggtggcggtctgctggcgacgcatggcgcgctggacttcgcgggcggtaccgttgtgcacattaacgccgcggtagcgggtctggttggcgcatacctgattggcaaacgcgtgggcttcggtaaagaagcgttcaaaccgcacaacctgccgatggtcttcaccggtaccgcgatcctctactttggctggtttggtttcaacgccggctcagcaagtgccgcgaacgaaatcgccgcgctggccttcgtgaataccgttgtggccacggcaggtgcaatcctctcctgggtctttggcgagtgggctgtgcgcggtaaaccttctctgctgggtgcctgttcgggggcgattgctggtctggtcggtatcaccccagcatgtggttatgtcggtgtgggtggcgcgctgctggtcggcctggtgtcaggtctggcgggtctgtggggcgtgacggcgctgaaacgtattctgcgcgttgatgacccttgcgatgtgtttggcgtgcacggcgtgtgcggcatcgtcggctgtatcatgaccggtatctttgcagcgaaatcgctgggtggcgtgggctacgcagaaggcgtcaccatggcccatcaggtgctggtgcagctggaaagtattgctgtcaccgtggtgtggtctgccgttgtcgctttcattggctacaaactggcggacatgacggttggtctgcgcgtgccggaagagcaggaacgcgaaggtctggacgtcaacagccacggcgagaatgcgtataacgcatga

SEQ ID NO: 168 - DNA, 1299 bp, Azospirillum lipoferum
  gene 1..1299: note = 16S
  variation 294: note = n is a, c, t, g, unknown or other
  variation 299: note = n is a, c, t, g, unknown or other
  variation 302: note = n is a, c, t, g, unknown or other
  variation 309..310: note = n is a, c, t, g, unknown or other
  variation 332: note = n is a, c, t, g, unknown or other
  variation 346: note = n is a, c, t, g, unknown or other
  variation 351: note = n is a, c, t, g, unknown or other
  variation 438: note = n is a, c, t, g, unknown or other
  variation 445: note = n is a, c, t, g, unknown or other
  variation 454: note = n is a, c, t, g, unknown or other
  variation 469: note = n is a, c, t, g, unknown or other
  variation 477: note = n is a, c, t, g, unknown or other
  variation 492: note = n is a, c, t, g, unknown or other
  variation 504: note = n is a, c, t, g, unknown or other
  variation 555: note = n is a, c, t, g, unknown or other
  variation 775: note = n is a, c, t, g, unknown or other
  source 1..1299: mol_type = genomic DNA
gccgagagaggggcccgcgtcggattaggtagttggtgaggtaatggctcaccaagccttcgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaatacgnagggngcnagcgttnntcggaattactgggcgtaaagngcgcgtaggcggcntgttnagtcagaagtgaaagccccgggctcaacctgggaatagcttttgatactggcaggcttgagttccggagaggatggtggaattcccngtgtagnggtgaaatncgtagatattgggangaacaccngtggcgaaggcggcnatctggacgganactgacgctgaggcgcgaaagcgtggggagcaaacaggattagataccctngtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactttgggctcgagagatngggtccttcagttcggctgggtggaacacaggtgctgcatggctgtcgtcagctcgtgtcgtgagatgttgggttaagtcccgcaacgagcgcaacccctaccgtcagttgccatcattcagttgggcactctggtggaaccgccggtgacaagccggaggaaggcggggatgacgtcaagtcctcatggcccttatgggttgggctacacacgtgctacaatggcggtgacagtgggaagcgaagtcgcgagatggagcaaatccccaaaagccgtctcagttcggatcgcactctgcaactcgagtgcgtgaagttggaatcgctagtaatcgcggatcagcacgccgcggtgaatacgttcccgggccttgtacacaccgcccgtcacaccatgggagttggttttacccgaaggtggtgcgctaaccgcaaggaggcagccaaccacggtaaggtcagcgactggggtgaagtcgtaacaaggtagccgtaggggaacctgcggctggatcacctccttt

SEQ ID NO: 169 - DNA, 897 bp, Azospirillum lipoferum
  gene 1..897: note = nifH
  source 1..897: mol_type = genomic DNA
atggccaaagcgcctctgcgtcagatcgccttttacggcaagggcggtatcggcaagtccaccacctctcagaacacgctggccgcgctggtcgagctggatcagaggatcctgatcgtcggctgcgacccgaaggccgactcgacccgcctgatcctgcacgcaaaggcccaggacaccgtcctgcatctggccgccgaggccggctcggtcgaggatctggagctcgaggacgttctcaagatcggctacaagaacatcaagtgcgtcgagtccggcggtccggagccgggggtcggctgcgccggccgcggcgtcatcacctcgatcaacttcctggaagagaacggcgcctacgacgacgtggactatgtgtcctacgacgtgctgggcgacgtggtctgcggcggcttcgccatgccgatccgcgagaacaaggcccaggaaatctacatcgtcatgtccggcgagatgatggcgctgtacgccgccaacaacatcgccaagggcatcctgaagtacgcgcacagcggcggcgtccgtctcggcggcctgatctgcaacgagcgccagaccgacaaggaatgggatctggccgacgcgctggccaagcgcctgggctccaagctgatccacttcgtgccgcgcgacaacatcgtccagcacgccgagctgcgccgcatgacggtcatcgagtacgccccggacagcaagcaggccggcgaataccgcgcgctcgccaacaagatccatgcgaactccggccagggttgcatcccgaccccgatcaccatggaagagctggaagagatgctgatggacttcggcatcatgaagaccgaggagcagcagctcgccgagctcgccgccaaggaagcggcgaaggccggcgcctga

SEQ ID NO: 170 - DNA, 1440 bp, Azospirillum lipoferum
  gene 1..1440: note = nifD1
  source 1..1440: mol_type = genomic DNA
atgagcctgtccgagaacaccacggtcgacgtcaagaacctcgtcaacgaagtcctcgaagcctatcccgaaaaatcccgcaagcgccgcgccaagcacctgaacgtgctggaggccgaggccaaggactgcggcgtcaagtcgaacgtcaagtccatccccggcgtcatgaccatccgcggctgcgcctatgccggctccaagggcgtggtgtggggtccgatcaaggacatgatccacatctcccacggtccggtcggctgcggctactactcctggtccggccgccgcaactactacatcggcgacaccggtgtggacagctggggcacgatgcacttcacctccgacttccaggagaaggacatcgtcttcggcggcgacaagaagctgcacaaggtcatcgaggaaatcaacgagctgttcccgctggtgaacggcatctcgatccagtcggaatgcccgatcggcctgatcggcgacgacatcgaggctgtcgcccgcgccaagtcggcggaaatcggcaagccggtcatccccgtgcgctgcgaaggcttccgcggcgtgtcccagtcgctgggccaccacatcgccaacgacgccatccgagactgggtgttcgagaagacggaacccaaggccggcttcgtctccaccccctatgacgtcaccatcatcggcgactacaacatcggcggcgacgcctggtcgtcccgcatcctgctggaggagatcggcctgcgcgtgatcgcccagtggtcgggcgacggcacgctcgccgaactggagaacacgccgaaggccaaggtcaacctgatccactgctaccgctcgatgaactacatcgcgcgccacatggaagagaagttcaacattccttggatggaatacaacttcttcggcccgagccagatcgccgaatccctgcgcaagatcgccgctctcttcgacgacaagatcaaggagaacgccgagaaggtcatcgcccgctaccagccgatggtcgatgcggtcatcgccaagtacaagccgcggctcgaaggcaagaaggtcatgatctacgtcggcggcctgcgtccccgccacgtcgtcgatgcctaccatgacctcggcatggagatcaccggcaccggctacgagttcgcccacaacgacgactatcagcgcacgcagcactacgtgaaggaaggcacgctgatctacgacgacgtcaccgcgttcgaactggagaagttcgtcgaggcgatgcgtcccgacctcgtcgcgtcgggcatcaaggaaaagtacgtgttccagaagatgggcctgccgttccgccagatgcacagctgggactactccggcccgtaccacggctatgacggcttcgcgatcttcgcccgcgacatggacctggccatcaacaaccccgtctggggcgtgatgaaggccccgttctga

SEQ ID NO: 171 - DNA, 1419 bp, Azospirillum lipoferum
  gene 1..1419: note = nifD2
  source 1..1419: mol_type = genomic DNA
atgctccaggacaagatccaggatgtcttcaacgaaccgggctgcgcgaccaaccaagccaaatcggccaaggagaagaagaagggctgcaccaagtcgctgaaaccgggggcggcagccggcggctgcgcctatgacggggcgatgatcgtgctccagccgatcgccgacgccgcccatctggtccatggccccatcgcctgcctcggaaacagttgggacaaccgcggctccaaatcctccggctcgcagctctaccgcaccggcttcaccaccgatctgtcggaactggacgtcatcggcggcggcgagaagaagctctaccgcgccatcaaggagatcgttcagcaatacgacccgccggccgtcttcgtctatcagacctgcgtgcccgccatgaccggcgacgacatcgccgcggtctgcaagttcgccacgcagaagctgggcaagccggtgatcccggtggactcgccgggcttcgtcgggtcgaagaatctcggcaacaagctggccggcgaagccctgctggagcatgtcatcggcacggtcgaaccggactacaccaccccgaccgacgtctgcatcatcggcgaatacaaccttgccggcgagctgtggctggtcaagccgctgctggacgagatcggcatccgcctcctgtcctgcatttccggcgacggccgctaccgggaggtggcgcaggcccaccgcgcccgcgtcaccatgatggtgtgcagccaggcgctggtgaatgtcgggcgcaagatggaggagcgctacggcatcccctatttcgaggggtccttctacggcgtgtccgacatgtcggacaccctgcgcaccatgacccgcatgctggtggagcgcggcgccgacaagggcctgatcgaccgggcggagggcgtgatcgcgcgggaggaaagccgggtctggcgccggctggaaccctacaagccgcgcttcgacggcaagcgcgtccttctcttcaccggcggcgtcaagagctggtcgatggtcagcgcgctggagggtgcggggctgaccatcctcggcacctccaccaagaaatcgaccagggaggacaaggagcgcatcaagaagatgaagggcgaagagttccaccagtgggacgatttgaagccgcgcgacatctacaggatgctggccgacgatcaggccgacatcatgatgtccggcggccgctcgcagttcatctcgctgaaggccaaggttccctggctcgacatcaaccaggagcgccaccacgcctatgccggctatgacggcatcgtcaatctctgcgaggagatcgacaaaacgctgtcgaatccgatctggcgtcaggtgcgtcagccggcaccgtgggagtccggcgcgtcctccacccttctggcttcctcgatggcggcggagtga

SEQ ID NO: 172 - DNA, 1383 bp, Azospirillum lipoferum
  gene 1..1383: note = nifK
  source 1..1383: mol_type = genomic DNA
atgtcccacatccagcgcttcccctccgccgccaaggccgcctccaccaacccgctgaagatgagccagccgctgggtgcggctctggcctatctcggcgtcgaccgctgcctgccgctgttccatggctcgcagggctgcaccgccttcgggctggtcctgctggtgcgccatttccgcgaggcgatcccgctccagaccacggcgatggatcaggtcgccaccatcctcggcggctacgacaatctggagcaggcgatccgcaccatcgtcgagcgcaaccagcccgccatgatcggcgtcgccaccaccggcgtcaccgagaccaagggcgaggatatggccggacagtacacgctgttccgccagcgcaaccccgacttggccgacacggccctggtcttcgccaacacccccgacttcgccggcggcttcgaggacggcttcgccgccgcggtcaccgcgatggtcgagcggttggtcgaaccgtcgccggtgcgcatcccgacccaggtcaacgtgctggccggctgccatctgtcccccggcgacgtggaggaactgcgcgacatcatcgaaggcttcggcctgtcgccgatcttcctgcccgacctgtcgctgtcgatggcgggccgccagccggccgacttcaccgccacctcgctgggcggcgtgaccgtcgatcagatccgcgccatgggcgcttcggccctcaccatcgtggtcggtgagcatatgcgggtggccggtaacgcgctggagctgaagaccgacgtgcccagccatttcttcaaccgcctgaccgggctggaggcgacggacaagctggtccggctgctgatggagttgtcgggcaagccggcgcccgcccggctgcggcgccagcgcgaaagcctggtcgatgccatgctcgacgggcatttcttctacagccgcaagcgcatcgccgtcgcgctggagcccgacctgctctatgccgtcaccggcttcctcgccgacatgggggccgaggtgatcgccgcggtgtccccgacgcagagcccggtgctggagcggttgaaggccgccaccatcatggtcggcgatcattccgacgtggagacgctggcccgcgacgccgacctgatcgtctccaactcgcacgggcggcagggagccgcgcggatcggcgtggctctgcaccgcatgggcctgccgctgttcgaccggctgggggccggcctgcgcgtccaggtcggctaccgcggcacgcgggaactgctgtgcgacatcggcaacctgttcctcgcccgcgagatggaccacgagcacgggcacgagagccacgaccacggggaatcccacggctgcggaggcggatcatgcggatgcaacgccgtctga

SEQ ID NO: 173 - DNA, 1560 bp, Azospirillum lipoferum
  gene 1..1560: note = nifK1
  source 1..1560: mol_type = genomic DNA
atgaccgacaagctttcgcagagcgccgacaaggtcctcgaccactacaccctcttccggcagcccgaatacgcggcgatgttcgagaagaagaagaccgagttcgagtacggccattcggacgaggaagtcgcccgcgtgtccgaatggaccaagtccgaggactacaaggcgaagaacttcgcccgtgaagcggtcgtcatcaacccgaccaaggcctgccagccgatcggcgcaatgttcgccgcccagggcttcgaaggcaccctgcccttcgtccacggctcccagggctgcgtcgcctattaccgcacccacctgacccgtcacttcaaggagccgaacagcgcggtctcctcgtcgatgacggaggacgcggcggtgttcggcggcctgaacaacatgatcgacggcctggcgaacgcctatgcgctctacaagccgaagatgatcgcggtgatgaccacctgcatggccgaagtcatcggcgacgatttgcagggcttcatcgccaatgcgaagaccaaggacagcgtcccggccgacttcccggtcccctacgcccacaccccggccttcgtcggcagccacatcgtcggctacgacaacatgatcaaggggatcctgaccaacttctggggtacgtcggagaatttcgacacacccaagaccgagcagatcaacctgatcccgggcttcgacggcttcgccgtcggcaacaaccgcgaactgaagcgcatcgccggcgaattcggcgtgaagctgcaaatcctgtccgacgtgtccgacaatttcgacacgccgatggatggcgagtaccgcatgtatgacggcggcaccaccatcgaggagaccaaggaggccctgcacgccaaggccaccatctccatgcaggagtacaacacgacccagaccctgcaattctgcaaggagaagggtcaggaagtcgccaagttcaactacccgatgggcgtcaccggcaccgacgagctgctgctgaagctcgccgaactgtcgggcaagccggtcccggccagcctgaagctggagcgcggccgtctggtcgacgccatcgccgacagccacacccacatgcacggcaagcgcttcgccgtctatggcgacccggacttctgcctgggcatgtccaagttcctgctggagctgggtgcggagccggtgcacatcctgtcgacgtcgggctccaagaagtgggagaagcaggtccagaaggtgctggacggctcgcccttcggcgcctcgggcaaggcccatggcggcaaggatctgtggcacctgcgttcgctgatcttcaccgacaaggtggactacatcatcggcaacagctacggcaagtatctggagcgcgacaccaaggttccgctgatccgcctgacctacccgatcttcgaccgccaccaccaccaccgctacccgacctggggctaccagggcgcgctgaacgtgctggtacggatcctggaccggatcttcgaggacatcgacgccaacaccaacatcgtcggccagaccgactactcgttcgacctgatccgctga

SEQ ID NO: 174 - DNA, 1530 bp, Azospirillum lipoferum
  gene 1..1530: note = nifA
  source 1..1530: mol_type = genomic DNA
atgttgacctctgatattgttggcaaattgcgctgcatcgcagcagaccccaaagcgggcatcgcaaggggcctcgacaccgggacgacgaagatcggtcccgtttgggagggtgacgtgggcgacaccgtggatttcgaagcgctgcgccagcgggcggtccactccctgttcgaacatctggaatccatgtgcgtcggcgccgtcgccgtcgaccacaccggccgcatcgcctggatggacgagaagtacaaggctctgctgggcgttcccgacgacccgcgcggccggcaggtggaggacgtcatccccaacagccagctgcgccgggtgatcgacagcggccagccgcagccgctggacatcatggagttcgacgaccggtccttcgtggtgacgcggatgccgctgttcggcaccgacggttcgatcatcggcgccatcggcttcgtgctgttcgaccgcgccgaatatctccgcccgctggtccgcaaatacgagaagatgcaggaggagctggcccgcacccagcaggagctggcgcatgagcgccgcgccaaatactccttctcgcagttcctgggcgccagcgaatcgatccgcgagatcaagcggctggggcgccgcgccgcccagatggattcgaccgtcctgctgctgggcgaaaccgggaccggcaaggagctgctggcccaggccatccattccgccagcccgcgggcgtccaagcccttcgtcggcgtcaatgtcgccgccattccggaaaccctgctggaggcggagttcttcggcgtcgcccccggcgccttcaccggcgccgaccgccgccaccgcgacggcaagttccagctcgccaacggcggcaccctgttcctcgacgagatcggcgacatgccgctgccggtgcaggccaagcttctgcgcgtgctgcaggagcgggagatcgagccgctcggctccaacaaggtggtgcgggtcgatgtccgcatcatcgccgccaccagccgtgacctgcacgccctggtgcgtgagaagcagttccgcgccgacctctattaccggctgaatgtggtgccgatcaccctgccgccgctgcgcgaccggccggaggacatcgagagcatcgccgaccgcatcctggaacagctggcgatccagcagggcacgccgccgcgcgagctgctggaatcggcggtgcaggtgctgcgcgactatgactggcccggcaatgtgcgcgagctttacaacacgctggaacgggtggtggcgctgaccgatgcgccgatcctgaccgcgccgcacatccgcagcgtgctgcccggccagcatccggccggcgcgtcggccctgccgctggcggccggcgcgcggccgttgcaggaggtgctgcacgccgccgagcgccacgccatcgccgcggcgcttgaggaggcgaacggcgtcaaggcgcgggcggcgaagctgctgggcatttcgcgcgcgtcgctgtacgaacgcatggtgacgctggggttgggggcgacgcagtag

SEQ ID NO: 175 - DNA, 3030 bp, Azospirillum lipoferum
  gene 1..3030: note = glnE
  source 1..3030: mol_type = genomic DNA
atgccgagtcccatcgcgttctcaagccccttgccgaagcctttcgacagcgcgcaggcggcgctggggatggagcgctggcgccagcaggccgccgcggcggagccggagacccgcgcctgggcggaagccttcgccgattcggagaccggccgggcgctgatcggggcggtgtgcggcaacagcccgtatctcggccacagcctgacgcgggagttgcccttcgtcgcccgtacagtgcaggacggcttcgacgacaccttcgccgcgctgatcgccgctctccatgccgagcatggcgaggagaaatcgatggaccggctgatggccggcctgcgggtggcgaagcggcgggcggcgctgctgatcgcgctggccgacatcgccggcgcgtggccgctgttccgcgtcaccggcgccctgtcggagctggcggagacgggggtgcagctggccgcgaatttcctgctgcgccgcgccagggaggcggggacgctgacgctgccggatccgcagcgaccgtgggtcggttcgggcctgatcgttttgggcatgggtaagcttggcgggcgcgaactcaactattccagcgacatcgacctgatcgtcctgtatgacgacgctgttgtgcagacgccccagccggacaacctcgcgcgaaccttcatcaggctcgcacgcgatcttgtccgcattatggatgaacggaccaaggacggctacgtcttccgcaccgaccttcggcttaggcccgatcccggcgccacgccgctggcggtttccgtctccgcagccgaaatttattacggcagcgtcggtcagaactgggaacgcgcggcgatgatcaaggcccgtcccatcgccggcgatctggaggcgggcgcctcctttgtccgcttcctggagcccttcgtctggcgccgcaacctggatttcgccgccatccaggacatccattcgatcaaacgccagatcaacgcccacaagggccaccgcgaggtgacggtcaacggccacgacatcaaggtcggccgcggcggcatccgcgagatcgagttcttcgcccagacccagcagctgatcttcggcgggcgcgacccgcgcgtgcgaatcgctccgaccctgatggcgaacgaggcgctgcgcgacgtcggccgcgtgccgccgcagacggtggaagagcttgccggggcctatcatttcctgcgccgtgtcgaacatcgcatccagatgatcgacgaccagcagacccatcgtattcccgccgacgatgccggggtggcgcatttggccaccttcctcggctatgacgaccccgccgccttccgggcggaactgctggcgacgctggggcaggtggaggaccgctatgccgagctgttcgaggaggcgccgtcgctttccggccccggcaatctggtcttcaccggcaccgaccccgatccgggcacgatggagacgctgaagggcatgggcttcgccgatccggcccgcgtcatcagcgtggtgtcggcctggcatcgcggccgctaccgcgccacccggtcgggccgggcgcgggagctgctgacggagctgacgccggccctgctgagtgcgctgaccaagaccccggcccccgattcggcgctgatgaacttcgacgatttcctcggcaagctgccggccggcgtcggtctgttctcgctgttcgtcgccaatccctggctcctggagctggtggcggagatcatgggcatcgcgccgcagatggcgcagacgctgtcgcgcaacccgtcgctgctcgacgccgtgctgtcgccggacttcttcgacccgctgccgggcaaggaggacgggctggccgacgaccacgcccgcgtgatggcgccggcccgcgatttcgaggatgcgctgaccctgtcgcggcgctggaccaacgaccagcgcttccgcgccggggtgcatatcctgcgcggcatcaccgatggcgaccgctgcggcgccttcctggccgatctggccgacatcgtcgtccccgaccttgcccgccgggtggaggaggagttcgcccagcgccacggccatattcccggcggcgcctgggtggtggtggcgatgggcaagctcggcagccggcagctgaccatcacgtccgacatcgacctgatcgtcatctacgatgtggcgccgggccaagggggcgggggcggtccccgcttgtcggatggtgccaagccgctgtcgcccaacgagtattacatcaagctgactcagcgtctgaccaacgccattaccgcgccgatgggcgacggccggctctacgaggtcgacatgcggctgcgcccgtcgggcaacgccgggccgctcgccacctcgctggacgctttcctgaaatatcaggcgaccgatgcctggacctgggagcatatggccctgacccgcgcccgggtgatcggcggtgatgcggagctggccgggcgggtgtcggcagcgatccgctcggtgctgacggcgccgcgcgatgccgaccggctgctgtgggacgtggccgacatgcggcggcggatcgagaaggagttcgggacgaccaatgtctggaacgtcaaatacgcccgcggcggcctgatcgacatcgagttcatcgcccagtacctgcaactgcgccatggtcacgagcggccggacatcctgcacatcggcaccgccaaggcgctgggctgcgccgcccggacgggcgcgctggcgccggaggtggcggaggatctggagacgacgctgcggctgtggcggcgggtgcagggctttctgcggttgaccaccgccggggtgctcgatcccaatcaggtgtcgcccagcctgctggccgggctggtccgcgccgcctttcctgctgactttcagggcgagcgtgagcctggcactgttgacttccccgaactggaccacaaaatccgtgccgtcgccgcccgcgcccatggtcatttcaagaccctggtcgaggaaccggcgggccgtctggccccacccgccaccacgcctccagcctga

SEQ ID NO: 176 - DNA, 1440 bp, Azospirillum lipoferum
  gene 1..1440: note = amtB1
  source 1..1440: mol_type = genomic DNA
atgaaccgtctgttccttatggccgcaccgatgatggcggttgctctgggcgcggtcggcatgccggccgcagcccttgcccaggatccggcggctgccgccgctgccgcggctgcggctgcggctgccgccgctgctgccgcaccggcggctccggcgctgaatggcggcgacaccgcctggatgctcatctccaccgcgctggtgctgatgatgaccatccccggcctggcgctgttctacggcggcatggtccgcaagatgaacgtgctgtcgacggtgatgcagagcttcgccatcacctgcctgatcagcgtcctgtggtacgtcatcggctacagcctggccttcaccggcaccggtgcctatgtcggcggtctcgaccggctgttcctcaacgggctcgacttcacgaaggccttcgtgctgggcgaggcgaccgggtcgggcgtcccgacgaccatccccgagccggtcttcatgatgttccagatgacctttgcgatcatcaccccggccctgatcaccggcgccttcgccgaccgcatgaagttctcctccctgctggtcttcaccgcgctgtggtcgatcgtggtctatgcgccgatcgcccactgggtctggtacccgtcgggcttcctgttcggcctgggcgtgctggacttcgccggcggcacggtcgtgcacatcaacgccggcgtcgccggcctggtcgccgcgctggtgatcggcaagcgcaagggctacccgaaggaagccttcatgccgcacaacctggtgctgtcgctgatcggcgcctcgctgctgtgggtcggctggttcggcttcaacgccggttcggccctgaccgccggtccgcgtgccggcatggcgctggccgccacgcacatcgccaccgccggtgccgccatgggctggctgttcgcggagtggatcgtcaagggcaagccgtcgatcctcggcatcatctccggcgccgtcgccggcctggtcgcggtgaccccggccgccggcttcgtcgacccgacgggcgccatcgtcatcggcatcgtcgccggcgtggtctgcttctggtcggccaccagcctcaagcacatgctgggctatgacgacagcctggacgccttcggcgtgcacggcgtcggcggcctgatcggcgccatcctgaccggcgtcttcgccaagatgtcggtgtccaacagcgaaggcggcttcgcctccgtcctgcaggccgacccgaaggccacgctgggcctgctggaaggcaacgccgccgccgtctggatccaggtccagggcgtcctctacaccatggtctggtgcgccatcgccaccttcgtcctgctgaagatcgtcgatgtggtcatgggcctgcgcgtcgaagaggatgtggagcgcgacggtctcgacctcgccctgcatggcgagagcatccactaa

SEQ ID NO: 177 - DNA, 1227 bp, Azospirillum lipoferum
  gene 1..1227: note = amtB2
  source 1..1227: mol_type = genomic DNA
atggatgcggcaaagacgggtggcgacgtccttttcgtgctgatgggcgcggtgatggtgctggcgatgcattgcggcttcgccctgctggaggtcgggacggtccggcgcaagaatcaggtcaacgcgctggtgaagatcctgtcggacttcgccatgtcgaccatcgcctattttttcgtcggttatgccgtggcctacggcatcgacttcttcgccgacgcccacacgctggtcggcaagggaagcggcgggttcgcggcctatggctacgatctggtgaagttcttcttcctggcgaccttcgccgccgcggtgccggccatcgtctcgggcggcatcgccgagcgtgctaggttctggccgcaggccgccgccacgctggcgctgatcgcgctgttctatccattgctggaaggcacggtctggggcacccgcttcggcctgcaaagctggatggccgcgaccttcggccagcctttccacgacttcgccggatctgtggtggtgcatgccttcggcggctgggtggcgctgggtgccgtgctgaacctcggcaaccgccgcggccgctaccgtccgaacggctcgctgatcgccattccgccgtcgaacatccccttcctggcgctgggcgcctgggtgctgtgcgtggggtggttcggcttcaacgtgatgagcgcccaggtgctggatggcgtgacgggtctggtggcgctgaactcgctgatggcgatggtcggcggcatcgtcacctcgctggtgatcagccgcaccgatcccggcttcgtccacaacggcgcgctggccggtctggtggcggtctgcgccgggtccgacgtgatgcacccgctgggcgcgctggtcaccggcggcatcgccgggctgctgttcgtctgggccttcaacaaatgccagatcgactggaagatcgacgacgtgctgggcgtctggccgctgcacggtctgtgcggcctgaccggcggcctgctggccggcgtcttcgggcaggaggcactgggcggccttggcggcgtgtcgatcctcagccagatcgtcggcacggcaagcggcgccagcttcggattcgtctcgggtctggcggtctacggcctgctgcgcgtcaccgtcggcatccgcctcgatcccgagcaggagtacaagggcgccgacttgtcgttgcaccatatcaccgcgtacccggaagaggacgcgccgaccctgtaa

SEQ ID NO: 178 - DNA, 613 bp, synthetic construct
  misc_feature 1..613: note = Synthetic polynucleotide
  misc_feature 1..613: note = delta-nifL::PinfC
  source 1..613: mol_type = other DNA
atgaccctgaatatgatgatggattcttggttctctggagcgctttatcggcatcctgactgaagaatttgcaggcttcttcccaacctggcttgcacccgtgcaggtagttgtgatgaacatcactgattcgcaggctgaatacgttaacgaattgacccgtaaactgcaaaatgcgggcattcgtgtaaaagcagacttgagaaacgagaagattggctttaaaatccgcgagcacactttacgtcgtgtcccttatatgctggtttgtggtgacaaagaggtcgaagccggcaaagttgctgtgcgtacccgtcgcggtaaagacctgggtagcctggacgtaaatgatgttatcgagaagctgcaacaagagattcgcagccgcagtcttcaacaactggaggaataaggtattaaaggcggaaaacgagttcaaacggcgcgtcccaatcgtattaatggcgagattcgcgccacggaagttcgcttaacaggtctggaaggcgagcagcttggtattgcgatagaactcacttcacgccccgaagggggaagctgcctgaccctacgattcccgctatttcattcactgaccggaggttcaaaatga

SEQ ID NO: 179 - DNA, 1613 bp, synthetic construct
  misc_feature 1..1613: note = Synthetic polynucleotide
  misc_feature 1..1613: note = delta-nifL::PinfC with 500bp flank
  source 1..1613: mol_type = other DNA
accggataagagagaaaagtgtcgacgtcggtccggttgatattgaccggcgcatccgccagctcgcccagtttttggtggatctgtttggcgattttgcgggtcttgccggtgtcggtgccgaaaaaaataccaatatttgccataacacacgctcctgttgaaaaagagatcccgcggggaaaatgcggtgaacatgtcagctattgcgaagagtgtgccagttttgctcacgggcaaaagctgcaccagaatgggtattaatgcaccagcctggcgctttttttcgcggcacgtcccctcgctaatgcccgtctggcgcggctttgacgctgataaggcgctgaataccgatctggatcaaggttttgtcgggttatcgtccaaaaggtgcactctttgcatggttataagtgcctgacatggtgtccgggcgaacgtcgccaggtggcacaaattgtcagaactacgacacgactaaccgaccgcaggagtgtgcgatgaccctgaatatgatgatggattcttggttctctggagcgctttatcggcatcctgactgaagaatttgcaggcttcttcccaacctggcttgcacccgtgcaggtagttgtgatgaacatcactgattcgcaggctgaatacgttaacgaattgacccgtaaactgcaaaatgcgggcattcgtgtaaaagcagacttgagaaacgagaagattggctttaaaatccgcgagcacactttacgtcgtgtcccttatatgctggtttgtggtgacaaagaggtcgaagccggcaaagttgctgtgcgtacccgtcgcggtaaagacctgggtagcctggacgtaaatgatgttatcgagaagctgcaacaagagattcgcagccgcagtcttcaacaactggaggaataaggtattaaaggcggaaaacgagttcaaacggcgcgtcccaatcgtattaatggcgagattcgcgccacggaagttcgcttaacaggtctggaaggcgagcagcttggtattgcgatagaactcacttcacgccccgaagggggaagctgcctgaccctacgattcccgctatttcattcactgaccggaggttcaaaatgacccagcgaaccgagtcgggtaataccgtctggcgcttcgatttatcccagcagttcaccgcgatgcagcggataagcgtggttctcagccgggcgaccgaggttgaacagacactccagcaggtgctgtgcgtattgcacaatgacgcctttttgcagcacggcatgatctgtctgtacgacagccagcaggcgattttgactattgaagcgttgcaggaagccgatcagcagttgatccccggcagctcgcaaattcgctaccgtccgggtgaagggctggtcgggacggtgctttcgcaggggcaatcgttagtgctggcgcgtgtggctgacgatcagcgctttcttgaccgcctgggactgtatgattacaacctgccgtttatcgccgtgccgctgatagggccggatgcgcagacttttggcgtgctgacggcgcaaccgatggcgcgttacgaagagcggttacccgcctgcacccgctttctggaaacggtc

SEQ ID NO: 180 - DNA, 1185 bp, synthetic construct
  misc_feature 1..1185: note = Synthetic polynucleotide
  misc_feature 1..1185: note = glnE-delta-AR-2
  source 1..1185: mol_type = other DNA
tccctgtgcgccgcgtcgccgatggtggccagccaactggcgcgctacccgatcctgctcgatgaactgctcgacccgaacacgctctatcaaccgacggcgatgaacgcctatcgcgatgaactgcgacaatacctgttgcgcgtgccggaagaggatgaagagcagcaactggaggcgctacggcagtttaagcaggcgcagttgttgcgcgtagcggcggcggatatcgccggtacgttacccgtcatgaaagtgagcgatcacttaacctggctggcggaagcgattatcgatgcggtggtgcagcaagcctggaaccagatggtggcgcgttacggccagccgacgcatctgcacgatcgcgaagggcgcggtttcgccgtggtcggttacggcaaacttggcggctgggaattaggttacagctccgatctggatctggtgttcctgcacgactgccccatggatgtgatgaccgatggcgagcgtgaaatcgatggccgccagttctatttgcgcctcgcgcagcgcgtgatgcacctgttcagcacgcgcacgtcgtccggcattctttatgaagtcgatgcgcgtttgcgcccgtccggcgcggccggaatgctggtgaccactgcggaagcgttcgccgattatcaaaaaaatgaagcctggacatgggagcatcaggcgctggcgcgtgcgcgcgtggtgtacggcgatccgcaactgaccgccgaatttgacgccattcgccgcgatatcctgatgacctcccgcgatgccgctaccctgcaaaccgaagtgcgggaaatgcgtgagaaaatgcgcgcccatcttggtaacaagcacaaagaccgtttcgatctgaaagccgatgaaggcggtatcaccgatattgagtttatcgctcagtatctggtgctgcgctttgcccatgagaagccgaaactgacgcgctggtcggataatgtgcgcatcctcgaagggctggcgcaaaacggcatcatggatgagcaggaagcgcaggcattgacgctggcgtacaccacgttgcgtgatgagctgcaccacctggcgctgcaagagctgccaggacatgtggcgctctcctgttttgtcgccgagcgtgcgcttatcaaaaccagctgggacaagtggctggtggaaccgtgcgccccggcgtaa

SEQ ID NO: 181 - DNA, 2085 bp, synthetic construct
  misc_feature 1..2085: note = Synthetic polynucleotide
  misc_feature 1..2085: note = glnE-delta-AR-2 with 500bp flank
  source 1..2085: mol_type = other DNA
taaagcgagcgctcacttacgtgatctgttgacgcagtccgaagcgaccattacttcagccgtttcagcagatacggcggtgtggagtgcgcaatcagccctggcgaaactggtgctcaccgagtggttagtgacgcagggctggcgaaccttccttgatgaaaaagcgcaggctaagtttgccgactcctttaaacgctttgctgacgttcatctgtcacgcagcgccgccgagctgaaaaaagcctttgcccagccgctgggcgacagctatcgcgaccagttaccgcggctggcgcgtgatatcgacagcgcgttattgctggccggacattacgatcgcgcgcgcgccgtggagtggctggaaaactggcaggggcttcagcacgctattgaaacgcgccagagagttgaaatcgaacatttccgtaataccgccattacccaggagccgttctggttgcacagcggaaaacgttaacgaaaggatatttcgcatgtccctgtgcgccgcgtcgccgatggtggccagccaactggcgcgctacccgatcctgctcgatgaactgctcgacccgaacacgctctatcaaccgacggcgatgaacgcctatcgcgatgaactgcgacaatacctgttgcgcgtgccggaagaggatgaagagcagcaactggaggcgctacggcagtttaagcaggcgcagttgttgcgcgtagcggcggcggatatcgccggtacgttacccgtcatgaaagtgagcgatcacttaacctggctggcggaagcgattatcgatgcggtggtgcagcaagcctggaaccagatggtggcgcgttacggccagccgacgcatctgcacgatcgcgaagggcgcggtttcgccgtggtcggttacggcaaacttggcggctgggaattaggttacagctccgatctggatctggtgttcctgcacgactgccccatggatgtgatgaccgatggcgagcgtgaaatcgatggccgccagttctatttgcgcctcgcgcagcgcgtgatgcacctgttcagcacgcgcacgtcgtccggcattctttatgaagtcgatgcgcgtttgcgcccgtccggcgcggccggaatgctggtgaccactgcggaagcgttcgccgattatcaaaaaaatgaagcctggacatgggagcatcaggcgctggcgcgtgcgcgcgtggtgtacggcgatccgcaactgaccgccgaatttgacgccattcgccgcgatatcctgatgacctcccgcgatgccgctaccctgcaaaccgaagtgcgggaaatgcgtgagaaaatgcgcgcccatcttggtaacaagcacaaagaccgtttcgatctgaaagccgatgaaggcggtatcaccgatattgagtttatcgctcagtatctggtgctgcgctttgcccatgagaagccgaaactgacgcgctggtcggataatgtgcgcatcctcgaagggctggcgcaaaacggcatcatggatgagcaggaagcgcaggcattgacgctggcgtacaccacgttgcgtgatgagctgcaccacctggcgctgcaagagctgccaggacatgtggcgctctcctgttttgtcgccgagcgtgcgcttatcaaaaccagctgggacaagtggctggtggaaccgtgcgccccggcgtaagtgtggtatcatcgcgcgcaaattttgtatctctcaggagacaggaatgaaagttacgctgccagagttcaatcaagccggtgtcatggtggtgggtgatgtgatgctggatcgctactggtacggcccaaccagccgcatttctccggaagcgccagttccggttgttaaagtcgatactattgaagagcgaccgggcggtgcggcaaacgtggcgatgaacattgcctcgctgggcgcaacggcgcgtctggttggcctgactggcattgatgatgcggcgcgcgcgctgagcaaagcgctggcggatgttaatgttaaatgtgacttcgtttctgttccgactcaccccaccatcactaagctgcgcgtgctgtcgcgtaaccagcaactgattcgc

SEQ ID NO: 182 - DNA, 461 bp, synthetic construct
  misc_feature 1..461: note = Synthetic polynucleotide
  misc_feature 1..461: note = delta-nifL::Prm1
  source 1..461: mol_type = other DNA
atgaccctgaatatgatgatggatgccagccgttctgtaataataaccggacaattcggactgattaaaaaagcgccctcgcggcgctttttttatattctcgactccatttaaaataaaaaatccaatcggatttcactatttaaactggccattatctaagatgaatccgatggaagctcgctgttttaacacgcgttttttaaccttttattgaaagtcggtgcttctttgagcgaacgatcaaatttaagtggattcccatcaaaaaaatattctcaacctaaaaaagtttgtgtaatacttgtaacgctacatggagattaactcaatctagagggtattaataatgaatcgtactaaactggtactgggcgcaactcacttcacgccccgaagggggaagctgcctgaccctacgattcccgctatttcattcactgaccggaggttcaaaatga

SEQ ID NO: 183 - DNA, 1461 bp, synthetic construct
  misc_feature 1..1461: note = Synthetic polynucleotide
  misc_feature 1..1461: note = delta-nifL::Prm1 with 500bp flank
  source 1..1461: mol_type = other DNA
accggataagagagaaaagtgtcgacgtcggtccggttgatattgaccggcgcatccgccagctcgcccagtttttggtggatctgtttggcgattttgcgggtcttgccggtgtcggtgccgaaaaaaataccaatatttgccataacacacgctcctgttgaaaaagagatcccgcggggaaaatgcggtgaacatgtcagctattgcgaagagtgtgccagttttgctcacgggcaaaagctgcaccagaatgggtattaatgcaccagcctggcgctttttttcgcggcacgtcccctcgctaatgcccgtctggcgcggctttgacgctgataaggcgctgaataccgatctggatcaaggttttgtcgggttatcgtccaaaaggtgcactctttgcatggttataagtgcctgacatggtgtccgggcgaacgtcgccaggtggcacaaattgtcagaactacgacacgactaaccgaccgcaggagtgtgcgatgaccctgaatatgatgatggatgccagccgttctgtaataataaccggacaattcggactgattaaaaaagcgccctcgcggcgctttttttatattctcgactccatttaaaataaaaaatccaatcggatttcactatttaaactggccattatctaagatgaatccgatggaagctcgctgttttaacacgcgttttttaaccttttattgaaagtcggtgcttctttgagcgaacgatcaaatttaagtggattcccatcaaaaaaatattctcaacctaaaaaagtttgtgtaatacttgtaacgctacatggagattaactcaatctagagggtattaataatgaatcgtactaaactggtactgggcgcaactcacttcacgccccgaagggggaagctgcctgaccctacgattcccgctatttcattcactgaccggaggttcaaaatgacccagcgaaccgagtcgggtaataccgtctggcgcttcgatttatcccagcagttcaccgcgatgcagcggataagcgtggttctcagccgggcgaccgaggttgaacagacactccagcaggtgctgtgcgtattgcacaatgacgcctttttgcagcacggcatgatctgtctgtacgacagccagcaggcgattttgactattgaagcgttgcaggaagccgatcagcagttgatccccggcagctcgcaaattcgctaccgtccgggtgaagggctggtcgggacggtgctttcgcaggggcaatcgttagtgctggcgcgtgtggctgacgatcagcgctttcttgaccgcctgggactgtatgattacaacctgccgtttatcgccgtgccgctgatagggccggatgcgcagacttttggcgtgctgacggcgcaaccgatggcgcgttacgaagagcggttacccgcctgcacccgctttctggaaacggtc

SEQ ID NO: 184 - DNA, 1185 bp, synthetic construct; identical to SEQ ID NO: 180
  misc_feature 1..1185: note = Synthetic polynucleotide
  misc_feature 1..1185: note = glnE-delta-AR-2
  source 1..1185: mol_type = other DNA

SEQ ID NO: 185 - DNA, 2085 bp, synthetic construct; identical to SEQ ID NO: 181
  misc_feature 1..2085: note = Synthetic polynucleotide
  misc_feature 1..2085: note = glnE-delta-AR-2 with 500bp flank
  source 1..2085: mol_type = other DNA

SEQ ID NO: 186 - DNA, 461 bp, synthetic construct; identical to SEQ ID NO: 182
  misc_feature 1..461: note = Synthetic polynucleotide
  misc_feature 1..461: note = delta-nifL::Prm1
  source 1..461: mol_type = other DNA

SEQ ID NO: 187 - DNA, 1461 bp, synthetic construct; identical to SEQ ID NO: 183
  misc_feature 1..1461: note = Synthetic polynucleotide
  misc_feature 1..1461: note = delta-nifL::Prm1 with 500bp flank
  source 1..1461: mol_type = other DNA

SEQ ID NO: 188 - DNA, 1185 bp, synthetic construct; identical to SEQ ID NO: 180
  misc_feature 1..1185: note = Synthetic polynucleotide
  misc_feature 1..1185: note = glnE-delta-AR-2
  source 1..1185: mol_type = other DNA

SEQ ID NO: 189 - DNA, 2085 bp, synthetic construct; identical to SEQ ID NO: 181
  misc_feature 1..2085: note = Synthetic polynucleotide
  misc_feature 1..2085: note = glnE-delta-AR-2 with 500bp flank
  source 1..2085: mol_type = other DNA

SEQ ID NO: 190 - DNA, 452 bp, synthetic construct
  misc_feature 1..452: note = Synthetic polynucleotide
  misc_feature 1..452: note = delta-nifL::Prm7
  source 1..452: mol_type = other DNA
atgaccctgaatatgatgatggatgccagccgcgtcaggttgaacgtaaaaaagtcggtctgcgcaaagcacgtcgtcgtccgcagttctccaaacgttaattggtttctgcttcggcagaacgattggcgaaaaaacccggtgcgaaccgggtttttttatggataaagatcgtgttatccacagcaatccattgattatctcttctttttcagcatttccagaatcccctcaccacaaagcccgcaaaatctggtaaactatcatccaattttctgcccaaatggctgggattgttcattttttgtttgccttacaacgagagtgacagtacgcgcgggtagttaactcaacatctgaccggtcgataactcacttcacgccccgaagggggaagctgcctgaccctacgattcccgctatttcattcactgaccggaggttcaaaatga

SEQ ID NO: 191 - DNA, 1451 bp, synthetic construct
  misc_feature 1..1451: note = Synthetic polynucleotide
  misc_feature 1..1451: note = delta-nifL::Prm7 with 500bp flank
  source 1..1451: mol_type = other DNA
accggataagagagaaaagtgtcgacgtcggtccggttgatattgaccggcgcatccgccagctcgcccagtttttggtggatctgtttggcgattttgcgggtcttgccggtgtcggtgccgaaaaaaataccaatatttgccataacacacgctcctgttgaaaaagagatcccgcggggaaaatgcggtgaacatgtcagctattgcgaagagtgtgccagttttgctcacgggcaaaagctgcaccagaatgggtattaatgcaccagcctggcgctttttttcgcggcacgtcccctcgctaatgcccgtctggcgcggctttgacgctgataaggcgctgaataccgatctggatcaaggttttgtcgggttatcgtccaaaaggtgcactctttgcatggttataagtgcctgacatggtgtccgggcgaacgtcgccaggtggcacaaattgtcagaactacgacacgactaaccgaccgcaggagtgtgcgatgaccctgaatatgatgatggatgccagccgcgtcaggttgaacgtaaaaaagtcggtctgcgcaaagcacgtcgtcgtccgcagttctccaaacgttaattggtttctgcttcggcagaacgattggcgaaaaaacccggtgcgaaccgggtttttttatggataaagatcgtgttatccacagcaatccattgattatctcttctttttcagcatttccagaatcccctcaccacaaagcccgcaaaatctggtaaactatcatccaattttctgcccaaatggctgggattgttcattttttgtttgccttacaacgagagtgacagtacgcgcgggtagttaactcaacatctgaccggtcgataactcacttcacgccccgaagggggaagctgcctgaccctacgattcccgctatttcattcactgaccggaggttcaaaatgacccagcgaaccgagtcgggtaataccgtctggcgcttcgatttatcccagcagttcaccgcgatgcagcggataagcgtggttctcagccgggcgaccgaggttgaacagacactccagcaggtgctgtgcgtattgcacaatgacgcctttttgcagcacggcatgatctgtctgtacgacagccagcaggcgattttgactattgaagcgttgcaggaagccgatcagcagttgatccccggcagctcgcaaattcgctaccgtccgggtgaagggctggtcgggacggtgctttcgcaggggcaatcgttagtgctggcgcgtgtggctgacgatcagcgctttcttgaccgcctgggactgtatgattacaacctgccgtttatcgccgtgccgctgatagggccggatgcgcagacttttggcgtgctgacggcgcaaccgatggcgcgttacgaagagcggttacccgcctgcacccgctttctggaaacggt

SEQ ID NO: 192 - DNA, 1191 bp, synthetic construct
  misc_feature 1..1191: note = Synthetic polynucleotide
  misc_feature 1..1191: note = glnE-delta-AR-2
  source 1..1191: mol_type = other DNA
atggcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctggaggcgttgcgccagtttaagcaggcgcagcagctgcatatcgcggcggcggatatcgctggtaccctgccggtgatgaaggtcagcgatcacttaacctggcttgccgaagcgatcctcgacgcggtggtgcagcaggcatgggggcagatggtcgctcgctacggccagccgacccacctgcacgatcgccagggtcgcggcttcgccgtcgtcggctacggtaagcttggcggctgggagctgggctacagctccgatctcgatctggtgttcctccatgactgcccggcggaggtgatgaccgacggcgagcgggagattgacggccgtcagttctacctgcggctggcccagcggatcatgcacctgttcagcacccgcacctcgtccggtattctctacgaagtggacgcccggctgcgtccttctggcgcggcggggatgctggtcaccaccgccgacgcgtttgctgactatcagcagaacgaagcctggacgtgggaacatcaggcgctggtgcgcgcccgcgtggtctatggcgacccggcgctgcaggcgcgctttgacgccattcgtcgcgatatcctgaccaccccgcgggaggggatgaccctgcagaccgaggttcgcgagatgcgcgagaagatgcgcgcccaccttggcaacaaacatcccgatcgttttgatatcaaagccgatgccggcgggatcaccgatattgaatttattactcagtatctggtcctacgctatgccagtgacaagccgaagctgacccgctggtctgacaacgtgcgtattcttgagctgctggcgcagaacgacatcatggacgaggaggaggcgcgcgccttaacgcatgcgtacaccaccttgcgtgatgcgctccatcacctggccctgcaggagcagccgggacacgtggcgccagaggccttcagccgggagcgtcagcaggtcagcgccagctggcagaagtggctgatggcttaa

SEQ ID NO: 193 - DNA, 2191 bp, synthetic construct
  misc_feature 1..2191: note = Synthetic polynucleotide
  misc_feature 1..2191: note = glnE-delta-AR-2 with 500bp flank
  source 1..2191: mol_type = other DNA
cgtaaggcgaccacccagctccgcgcgttgctgaacgacgctgaagccgttctgctggccgcggacaccgccgacgaggcgttattccgcaccgaggtcgtcggcgccaaactggccctgactgaatggctggtccagcgcggctggcgtccgttcctcaacgaggcaggagagaaaaaaatagccggatcgttcaaacggtttgccgatattaacctctcgcgggtggcggccgagctgcgcagcgccgtgcagcatctggcggttgaagatgccgccgaccagttgccgaagctgtcccgcgacatcgacagcgtccagctgctggcgggcgcctatggcgacgccgtcgcgccgtggctggagaactggcaggagcttcaccgtgcaatagcacatgacgatcgcagcgtctttgaatatttccgtcgccaggcgctggctgccgagccgttctggctgcatagtggaaaacgataatttcaggccagggagcccttatggcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctggaggcgttgcgccagtttaagcaggcgcagcagctgcatatcgcggcggcggatatcgctggtaccctgccggtgatgaaggtcagcgatcacttaacctggcttgccgaagcgatcctcgacgcggtggtgcagcaggcatgggggcagatggtcgctcgctacggccagccgacccacctgcacgatcgccagggtcgcggcttcgccgtcgtcggctacggtaagcttggcggctgggagctgggctacagctccgatctcgatctggtgttcctccatgactgcccggcggaggtgatgaccgacggcgagcgggagattgacggccgtcagttctacctgcggctggcccagcggatcatgcacctgttcagcacccgcacctcgtccggtattctctacgaagtggacgcccggctgcgtccttctggcgcggcggggatgctggtcaccaccgccgacgcgtttgctgactatcagcagaacgaagcctggacgtgggaacatcaggcgctggtgcgcgcccgcgtggtctatggcgacccggcgctgcaggcgcgctttgacgccattcgtcgcgatatcctgaccaccccgcgggaggggatgaccctgcagaccgaggttcgcgagatgcgcgagaagatgcgcgcccaccttggcaacaaacatcccgatcgttttgatatcaaagccgatgccggcgggatcaccgatattgaatttattactcagtatctggtcctacgctatgccagtgacaagccgaagctgacccgctggtctgacaacgtgcgtattcttgagctgctggcgcagaacgacatcatggacgaggaggaggcgcgcgccttaacgcatgcgtacaccaccttgcgtgatgcgctccatcacctggccctgcaggagcagccgggacacgtggcgccagaggccttcagccgggagcgtcagcaggtcagcgccagctggcagaagtggctgatggcttaactataaaatcgggtgtgctattatcgcgcgcaaagtttgcgtctcgcaggagagagtcatgaaagtaacgctgccggagtttgaacgtgcaggagtgttggtggtgggtgatgtgatgctggaccgctactggtacggccccaccagtcgtatttccccggaagccccggtgccggtggtgaaggtggaaaatatcgaagaacgtcctggcggcgcggcaaacgtagcgatgaacatcgcctccctgggggcaacgtcgcgcctggtgggattgaccgggattgatgacgctgcccgcgcgctgagccaggcgctggccaatgtgaatgtgaagtgcgacttcgtctccgtcccgactcacccgaccatcaccaagctgcgggtgctgtcgcgcaatcagcagctgatccgcctcgactttgaagagggcttctccggcgtggatccgcagccgatgcatgagcgcattcagcaggcgctgggagccattggcgcactgg

SEQ ID NO: 194 - DNA, 613 bp, synthetic construct
  misc_feature 1..613: note = Synthetic polynucleotide
  misc_feature 1..613: note = delta-nifL::PinfC
  source 1..613: mol_type = other DNA
atgaccctgaatatgatgctagaagcgtcaggtaccggtcatgattcaccgtgcgattctcggttccctggagcgcttcattggcatcctgaccgaagagttcgctggcttcttcccaacctggattgcaccagtgcaggtagtggtcatgaatattaccgattctcaggctgaatacgttaacgaattgacgcgtaaactacaaaatgcgggcattcgtgtaaaagcagacttgagaaatgagaagattggctttaaaatccgcgagcacactttacgtcgtgtcccgtatatgttggtctgtggcgacaaagaagtcgaagccggcaaagtggccgtgcgcacccgtcgcgggaaagacctcggcagcatggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgccctggaagttcgcgccattgagctggcttcccgaccgcagggcggcacctgcctgaccctgcgtttcccgctgtttaacaccctgaccggaggtgaagcatga

SEQ ID NO: 195 - DNA, 1613 bp, synthetic construct
  misc_feature 1..1613: note = Synthetic polynucleotide
  misc_feature 1..1613: note = delta-nifL::PinfC with 500bp flank
  source 1..1613: mol_type = other DNA
ggccgtcgcccagcgtcggcgtccccaacagcagggccgggtaggccagcaggtccgccagcgtggcgcggttaatattgaccggggcggcggcggcctcccccagctgcttgtggatcattttcgcgatcttgcgggttttaccggtatcggtaccaaagaaaatgccaatgttcgccatagtacgctcctgtcggaatggtgttgaaaaaaggaatgacgacagaggtattgcgaaggctgtgccaggttgccctgcaccgcgacggcccatccctgccccatcaggatcgcttcgcatcacgatgccgcgcgccaaaggcgcacccggcggggcgaaaggtaaaaatccgtgaattttccccctgtcggatcaatgtttcgcgtggtcgttccgataagggcgcacactttgcatggttatccgggttcggcttaccccgccgcgttttgcgcacggtgtcggacaatttgtcataactgcgacacaggagtttgcgatgaccctgaatatgatgctagaagcgtcaggtaccggtcatgattcaccgtgcgattctcggttccctggagcgcttcattggcatcctgaccgaagagttcgctggcttcttcccaacctggattgcaccagtgcaggtagtggtcatgaatattaccgattctcaggctgaatacgttaacgaattgacgcgtaaactacaaaatgcgggcattcgtgtaaaagcagacttgagaaatgagaagattggctttaaaatccgcgagcacactttacgtcgtgtcccgtatatgttggtctgtggcgacaaagaagtcgaagccggcaaagtggccgtgcgcacccgtcgcgggaaagacctcggcagcatggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgccctggaagttcgcgccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtc

SEQ ID NO: 196 - DNA, 1155 bp, synthetic construct
  misc_feature 1..1155: note = Synthetic polynucleotide
  misc_feature 1..1155: note = glnE-delta-AR-2 36bp deletion
  source 1..1155: mol_type = other DNA
atggcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctgcatatcgcggcggcggatatcgctggtaccctgccggtgatgaaggtcagcgatcacttaacctggcttgccgaagcgatcctcgacgcggtggtgcagcaggcatgggggcagatggtcgctcgctacggccagccgacccacctgcacgatcgccagggtcgcggcttcgccgtcgtcggctacggtaagcttggcggctgggagctgggctacagctccgatctcgatctggtgttcctccatgactgcccggcggaggtgatgaccgacggcgagcgggagattgacggccgtcagttctacctgcggctggcccagcggatcatgcacctgttcagcacccgcacctcgtccggtattctctacgaagtggacgcccggctgcgtccttctggcgcggcggggatgctggtcaccaccgccgacgcgtttgctgactatcagcagaacgaagcctggacgtgggaacatcaggcgctggtgcgcgcccgcgtggtctatggcgacccggcgctgcaggcgcgctttgacgccattcgtcgcgatatcctgaccaccccgcgggaggggatgaccctgcagaccgaggttcgcgagatgcgcgagaagatgcgcgcccaccttggcaacaaacatcccgatcgttttgatatcaaagccgatgccggcgggatcaccgatattgaatttattactcagtatctggtcctacgctatgccagtgacaagccgaagctgacccgctggtctgacaacgtgcgtattcttgagctgctggcgcagaacgacatcatggacgaggaggaggcgcgcgccttaacgcatgcgtacaccaccttgcgtgatgcgctccatcacctggccctgcaggagcagccgggacacgtggcgccagaggccttcagccgggagcgtcagcaggtcagcgccagctggcagaagtggctgatggcttaa

SEQ ID NO: 197 - DNA, 2155 bp, synthetic construct
  misc_feature 1..2155: note = Synthetic polynucleotide
  misc_feature 1..2155: note = glnE-delta-AR-2 36bp deletion
  source 1..2155: mol_type = other DNA
cgtaaggcgaccacccagctccgcgcgttgctgaacgacgctgaagccgttctgctggccgcggacaccgccgacgaggcgttattccgcaccgaggtcgtcggcgccaaactggccctgactgaatggctggtccagcgcggctggcgtccgttcctcaacgaggcaggagagaaaaaaatagccggatcgttcaaacggtttgccgatattaacctctcgcgggtggcggccgagctgcgcagcgccgtgcagcatctggcggttgaagatgccgccgaccagttgccgaagctgtcccgcgacatcgacagcgtccagctgctggcgggcgcctatggcgacgccgtcgcgccgtggctggagaactggcaggagcttcaccgtgcaatagcacatgacgatcgcagcgtctttgaatatttccgtcgccaggcgctggctgccgagccgttctggctgcatagtggaaaacgataatttcaggccagggagcccttatggcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctgcatatcgcggcggcggatatcgctggtaccctgccggtgatgaaggtcagcgatcacttaacctggcttgccgaagcgatcctcgacgcggtggtgcagcaggcatgggggcagatggtcgctcgctacggccagccgacccacctgcacgatcgccagggtcgcggcttcgccgtcgtcggctacggtaagcttggcggctgggagctgggctacagctccgatctcgatctggtgttcctccatgactgcccggcggaggtgatgaccgacggcgagcgggagattgacggccgtcagttctacctgcggctggcccagcggatcatgcacctgttcagcacccgcacctcgtccggtattctctacgaagtggacgcccggctgcgtccttctggcgcggcggggatgctggtcaccaccgccgacgcgtttgctgactatcagcagaacgaagcctggacgtgggaacatcaggcgctggtgcgcgcccgcgtggtctatggcgacccggcgctgcaggcgcgctttgacgccattcgtcgcgatatcctgaccaccccgcgggaggggatgaccctgcagaccgaggttcgcgagatgcgcgagaagatgcgcgcccaccttggcaacaaacatcccgatcgttttgatatcaaagccgatgccggcgggatcaccgatattgaatttattactcagtatctggtcctacgctatgccagtgacaagccgaagctgacccgctggtctgacaacgtgcgtattcttgagctgctggcgcagaacgacatcatggacgaggaggaggcgcgcgccttaacgcatgcgtacaccaccttgcgtgatgcgctccatcacctggccctgcaggagcagccgggacacgtggcgccagaggccttcagccgggagcgtcagcaggtcagcgccagctggcagaagtggctgatggcttaactataaaatcgggtgtgctattatcgcgcgcaaagtttgcgtctcgcaggagagagtcatgaaagtaacgctgccggagtttgaacgtgcaggagtgttggtggtgggtgatgtgatgctggaccgctactggtacggccccaccagtcgtatttccccggaagccccggtgccggtggtgaaggtggaaaatatcgaagaacgtcctggcggcgcggcaaacgtagcgatgaacatcgcctccctgggggcaacgtcgcgcctggtgggattgaccgggattgatgacgctgcccgcgcgctgagccaggcgctggccaatgtgaatgtgaagtgcgacttcgtctccgtcccgactcacccgaccatcaccaagctgcgggtgctgtcgcgcaatcagcagctgatccgcctcgactttgaagagggcttctccggcgtggatccgcagccgatgcatgagcgcattcagcaggcgctgggagccattggcgcactgg

SEQ ID NO: 198 - DNA, 412 bp, synthetic construct
  misc_feature 1..412: note = Synthetic polynucleotide
  misc_feature 1..412: note = delta-nifL::Prm8.2
  source 1..412: mol_type = other DNA
atgaccctgaatatgatgctcgacgccgtcctcgcagtaccattgcaaccgactttacagcaagaagtgattctggcacgcatggaacaaattcttgccagtcgggctttatccgatgacgaacgcgcacagcttttatatgagcgcggagtgttgtatgatagtctcggtctgagggcattagcgcgaaatgatttttcacaagcgctggcaatccgacccgatatgcctgaagtattcaattacttaggcatttacttaacgcaggcaggcaattttgatgctgcctatgaagcgtttgattctgtacttgagcttgatcgccattgagctggcttcccgaccgcagggcggcacctgcctgaccctgcgtttcccgctgtttaacaccctgaccggaggtgaagcatga

SEQ ID NO: 199 - DNA, 1389 bp, synthetic construct
  misc_feature 1..1389: note = Synthetic polynucleotide
  misc_feature 1..1389: note = delta-nifL::Prm8.2 with 500bp flank
  source 1..1389: mol_type = other DNA
cccaacagcagggccgggtaggccagcaggtccgccagcgtggcgcggttaatattgaccggggcggcggcggcctcccccagctgcttgtggatcattttcgcgatcttgcgggttttaccggtatcggtaccaaagaaaatgccaatgttcgccatagtacgctcctgtcggaatggtgttgaaaaaaggaatgacgacagaggtattgcgaaggctgtgccaggttgccctgcaccgcgacggcccatccctgccccatcaggatcgcttcgcatcacgatgccgcgcgccaaaggcgcacccggcggggcgaaaggtaaaaatccgtgaattttccccctgtcggatcaatgtttcgcgtggtcgttccgataagggcgcacactttgcatggttatccgggttcggcttaccccgccgcgttttgcgcacggtgtcggacaatttgtcataactgcgacacaggagtttgcgatgaccctgaatatgatgctcgacgccgtcctcgcagtaccattgcaaccgactttacagcaagaagtgattctggcacgcatggaacaaattcttgccagtcgggctttatccgatgacgaacgcgcacagcttttatatgagcgcggagtgttgtatgatagtctcggtctgagggcattagcgcgaaatgatttttcacaagcgctggcaatccgacccgatatgcctgaagtattcaattacttaggcatttacttaacgcaggcaggcaattttgatgctgcctatgaagcgtttgattctgtacttgagcttgatcgccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtc

SEQ ID NO: 200 - DNA, 1155 bp, synthetic construct; identical to SEQ ID NO: 196
  misc_feature 1..1155: note = Synthetic polynucleotide
  misc_feature 1..1155: note = glnE-delta-AR-2 36bp deletion
  source 1..1155: mol_type = other DNA

SEQ ID NO: 201 - DNA, 2155 bp, synthetic construct; identical to SEQ ID NO: 197
  misc_feature 1..2155: note = Synthetic polynucleotide
  misc_feature 1..2155: note = glnE-delta-AR-2 36bp deletion
  source 1..2155: mol_type = other DNA

SEQ ID NO: 202 - DNA, 413 bp, synthetic construct
  misc_feature 1..413: note = Synthetic polynucleotide
  misc_feature 1..413: note = delta-nifL::Prm6.2
  source 1..413: mol_type = other DNA
atgaccctgaatatgatgctcgagctaaagttctcggctaatcgctgataacatttgacgcaatgcgcaataaaagggcatcatttgatgccctttttgcacgctttcataccagaacctggctcatcagtgattttttttgtcataatcattgctgagacaggctctgaagagggcgtttatacaccaaaccattcgagcggtagcgcgacggcaagtcagcgttctcctttgcaatagcagggaagaggcgccagaaccgccagcgttgaagcagtttgaacgcgttcagtgtataatccgaaacttaatttcggtttggagccattgagctggcttcccgaccgcagggcggcacctgcctgaccctgcgtttcccgctgtttaacaccctgaccggaggtgaagcatga

SEQ ID NO: 203 - DNA, 1413 bp, synthetic construct
  misc_feature 1..1413: note = Synthetic polynucleotide
  misc_feature 1..1413: note = delta-nifL::Prm6.2 with 500bp flank
  source 1..1413: mol_type = other DNA
ggccgtcgcccagcgtcggcgtccccaacagcagggccgggtaggccagcaggtccgccagcgtggcgcggttaatattgaccggggcggcggcggcctcccccagctgcttgtggatcattttcgcgatcttgcgggttttaccggtatcggtaccaaagaaaatgccaatgttcgccatagtacgctcctgtcggaatggtgttgaaaaaaggaatgacgacagaggtattgcgaaggctgtgccaggttgccctgcaccgcgacggcccatccctgccccatcaggatcgcttcgcatcacgatgccgcgcgccaaaggcgcacccggcggggcgaaaggtaaaaatccgtgaattttccccctgtcggatcaatgtttcgcgtggtcgttccgataagggcgcacactttgcatggttatccgggttcggcttaccccgccgcgttttgcgcacggtgtcggacaatttgtcataactgcgacacaggagtttgcgatgaccctgaatatgatgctcgagctaaagttctcggctaatcgctgataacatttgacgcaatgcgcaataaaagggcatcatttgatgccctttttgcacgctttcataccagaacctggctcatcagtgattttttttgtcataatcattgctgagacaggctctgaagagggcgtttatacaccaaaccattcgagcggtagcgcgacggcaagtcagcgttctcctttgcaatagcagggaagaggcgccagaaccgccagcgttgaagcagtttgaacgcgttcagtgtataatccgaaacttaatttcggtttggagccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtc

SEQ ID NO: 204 - DNA, 513 bp, synthetic construct
  misc_feature 1..513: note = Synthetic polynucleotide
  misc_feature 1..513: note = delta-nifL::Prm1.2
  source 1..513: mol_type = other DNA
atgaccctgaatatgatgctcgagcccgctgaccgaccagaacttccaccttggactcggctatacccttggcgtgacggcgcgcgataactgggactacatccccattccggtgatcttaccattggcgtcaataggttacggtccggcgactttccagatgacctatattcccggcacctacaataacggtaacgtttacttcgcctgggctcgtatacagttttaattcgctaagtcttagcaataaatgagataagcggtgtgtcttgtggaaaaacaaggactaaagcgttacccactaaaaaagatagcgacttttatcactttttagcaaagttgcactggacaaaaggtaccacaattggtgtactgatactcgacacagcattagtgtcgatttttcatataaaggtaattttggccattgagctggcttcccgaccgcagggcggcacctgcctgaccctgcgtttcccgctgtttaacaccctgaccggaggtgaagcatga

SEQ ID NO: 205 - DNA, 1513 bp, synthetic construct
  misc_feature 1..1513: note = Synthetic polynucleotide
  misc_feature 1..1513: note = delta-nifL::Prm1.2 with 500bp flank
  source 1..1513: mol_type = other DNA
ggccgtcgcccagcgtcggcgtccccaacagcagggccgggtaggccagcaggtccgccagcgtggcgcggttaatattgaccggggcggcggcggcctcccccagctgcttgtggatcattttcgcgatcttgcgggttttaccggtatcggtaccaaagaaaatgccaatgttcgccatagtacgctcctgtcggaatggtgttgaaaaaaggaatgacgacagaggtattgcgaaggctgtgccaggttgccctgcaccgcgacggcccatccctgccccatcaggatcgcttcgcatcacgatgccgcgcgccaaaggcgcacccggcggggcgaaaggtaaaaatccgtgaattttccccctgtcggatcaatgtttcgcgtggtcgttccgataagggcgcacactttgcatggttatccgggttcggcttaccccgccgcgttttgcgcacggtgtcggacaatttgtcataactgcgacacaggagtttgcgatgaccctgaatatgatgctcgagcccgctgaccgaccagaacttccaccttggactcggctatacccttggcgtgacggcgcgcgataactgggactacatccccattccggtgatcttaccattggcgtcaataggttacggtccggcgactttccagatgacctatattcccggcacctacaataacggtaacgtttacttcgcctgggctcgtatacagttttaattcgctaagtcttagcaataaatgagataagcggtgtgtcttgtggaaaaacaaggactaaagcgttacccactaaaaaagatagcgacttttatcactttttagcaaagttgcactggacaaaaggtaccacaattggtgtactgatactcgacacagcattagtgtcgatttttcatataaaggtaattttggccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtc

SEQ ID NO: 206 - DNA, 1155 bp, synthetic construct; identical to SEQ ID NO: 196
  misc_feature 1..1155: note = Synthetic polynucleotide
  misc_feature 1..1155: note = glnE-delta-AR-2 36bp deletion
  source 1..1155: mol_type = other DNA

SEQ ID NO: 207 - DNA, 2155 bp, synthetic construct; identical to SEQ ID NO: 197
  misc_feature 1..2155: note = Synthetic polynucleotide
  misc_feature 1..2155: note = glnE-delta-AR-2 36bp deletion
  source 1..2155: mol_type = other DNA

SEQ ID NO: 208 - DNA, 613 bp, synthetic construct; identical to SEQ ID NO: 194
  misc_feature 1..613: note = Synthetic polynucleotide
  misc_feature 1..613: note = delta-nifL::PinfC
  source 1..613: mol_type = other DNA

SEQ ID NO: 209 - DNA, 1613 bp, synthetic construct; identical to SEQ ID NO: 195
  misc_feature 1..1613: note = Synthetic polynucleotide
  misc_feature 1..1613: note = delta-nifL::PinfC with 500bp flank
  source 1..1613: mol_type = other DNA

SEQ ID NO: 210 - DNA, 1191 bp, synthetic construct; identical to SEQ ID NO: 192
  misc_feature 1..1191: note = Synthetic polynucleotide
  misc_feature 1..1191: note = glnE-delta-AR-2
  source 1..1191: mol_type = other DNA

SEQ ID NO: 211 - DNA, 2191 bp, synthetic construct; identical to SEQ ID NO: 193
  misc_feature 1..2191: note = Synthetic polynucleotide
  misc_feature 1..2191: note = glnE-delta-AR-2 with 500bp flank
  source 1..2191: mol_type = other DNA

SEQ ID NO: 212 - DNA, 1188 bp, synthetic construct
  misc_feature 1..1188: note = Synthetic polynucleotide
  misc_feature 1..1188: note = glnE-delta-AR-2
  source 1..1188: mol_type = other DNA
atggcgctcaaacagttaatccgtctgtgtgccgcctcgccgatggtcgcgacacaacttgcacgtcatcctttattgctcgatgaactgctcgacccgcgcacgctttaccagccgattgagccgggcgcttaccgcgacgaactgcgtcagtatctgatgcgggtgccaacagaagacgaagaacagcagcttgaagccgtgcgccagttcaaacaggcccagcatttgcgtatcgcagccggggatatttccggggcattgccggtgatgaaagtcagtgaccatttaacctaccttgccgaggccattctcgatgtcgtggtgcagcatgcgtgggaacaaatggtcgtaaaatacgggcagcccgcgcatcttcagcaccgtgaggggcgcggttttgccgtggtcggttacgggaaactcggtggctgggagctgggttatagctcagatctggatctggtcttcctgctcgattgcgcgccggaggtgatgacggacggcgaacgcagcatcgacggacgtcagttttatcttcggctggcgcagcgcattatgcacttattcagcacccggacatcgtcaggcattctttacgaggttgatccgcgtctgcgaccttccggcgcatccggcatgctggtcagtaccattgaagcgtttgcagattatcaggccaatgaagcctggacgtgggagcatcaggcgctggttcgcgcgcgcgtggtttacggggatccgcaactgacacagcaatttaacgccacgcgtcgcgacattctttgccgccagcgcgatggcgacggcctgcgtaaggaggtccgtgaaatgcgcgagaaaatgtatgcccatctggggagtaaaaaagcccacgagtttgatctgaaagccgatccgggtggcatcacggatattgaattcattgcacaatacctggttctgcgtttcgcgcatgatgagccgaagctgacgcgctggtctgataacgtgcggatttttgaactgatggcacgatatgacatcatgccggaagaggaagcgcgccatctgacgcaggcttatgtgacgctgcgcgatgaaattcatcatctggcgttgcaggaacacagcgggaaagtggccgcggacagctttgctactgagcgcgcgcagatccgtgccagctgggcaaagtggctcggctga

SEQ ID NO: 213 - DNA, 2188 bp, synthetic construct
  misc_feature 1..2188: note = Synthetic polynucleotide
  misc_feature 1..2188: note = glnE-delta-AR-2 with 500bp flank
  source 1..2188: mol_type = other DNA
cggtactggaacagaaatcggcggatgcgcaggaaatttgttatgacacggcctgtctgaagtgcaagttagtgcttacttcctggctggcaacctcaggctggacgccgtttattgatgataaatctgcgaagaaactggacgcttccttcaaacgttttgctgacatcatgctcggtcgtaccgcagcggatctgaaagaagcctttgcgcagccactgacggaagaaggttatcgcgatcagctggcgcgcctgaaacgccagatcattaccttccatttgcttgccggtgcttaccctgaaaaagacgtcgatgcgtatattgccggctgggtggacctgcaacaggccatcgttcagcagcaacacgcctgggaggattcggcccgttctcacgcggtgatgatggatgctttctggttaaacgggcaacctcgttaactgactgactagcctgggcaaactgcccgggcttttttttgcaaggaatctgatttcatggcgctcaaacagttaatccgtctgtgtgccgcctcgccgatggtcgcgacacaacttgcacgtcatcctttattgctcgatgaactgctcgacccgcgcacgctttaccagccgattgagccgggcgcttaccgcgacgaactgcgtcagtatctgatgcgggtgccaacagaagacgaagaacagcagcttgaagccgtgcgccagttcaaacaggcccagcatttgcgtatcgcagccggggatatttccggggcattgccggtgatgaaagtcagtgaccatttaacctaccttgccgaggccattctcgatgtcgtggtgcagcatgcgtgggaacaaatggtcgtaaaatacgggcagcccgcgcatcttcagcaccgtgaggggcgcggttttgccgtggtcggttacgggaaactcggtggctgggagctgggttatagctcagatctggatctggtcttcctgctcgattgcgcgccggaggtgatgacggacggcgaacgcagcatcgacggacgtcagttttatcttcggctggcgcagcgcattatgcacttattcagcacccggacatcgtcaggcattctttacgaggttgatccgcgtctgcgaccttccggcgcatccggcatgctggtcagtaccattgaagcgtttgcagattatcaggccaatgaagcctggacgtgggagcatcaggcgctggttcgcgcgcgcgtggtttacggggatccgcaactgacacagcaatttaacgccacgcgtcgcgacattctttgccgccagcgcgatggcgacggcctgcgtaaggaggtccgtgaaatgcgcgagaaaatgtatgcccatctggggagtaaaaaagcccacgagtttgatctgaaagccgatccgggtggcatcacggatattgaattcattgcacaatacctggttctgcgtttcgcgcatgatgagccgaagctgacgcgctggtctgataacgtgcggatttttgaactgatggcacgatatgacatcatgccggaagaggaagcgcgccatctgacgcaggcttatgtgacgctgcgcgatgaaattcatcatctggcgttgcaggaacacagcgggaaagtggccgcggacagctttgctactgagcgcgcgcagatccgtgccagctgggcaaagtggctcggctgagggtttttattcggctaacaggcgcttgtgatattatccggcgcattgtatttacccgatttgatttatctgttttggagtcttgggatgaaagtgactttgcctgattttcaccgcgcaggtgtgctggttgtcggtgacgtaatgttagaccgttactggtatggcccgaccaatcgtatttctccggaagctccggtgccggtggtgaaggtcagtaccattgaagagcggcctggcggtgcagctaacgtggcgatgaacatttcatctctgggcgcctcttcctgtctgatcggcctgaccggcgtagacgacgctgcgcgtgccctcagtgagcgtctggcagaagtgaaagttaactgcgatttcgtcgcactatccacacatcctaccatcaccaaactgcgaattttgtcccgtaaccagcaactgatccgcctcgactttgaggaaggttttgaaggcgttgatctcgagccgatgctgaccaaaataga

SEQ ID NO: 214 - DNA, 635 bp, synthetic construct
  misc_feature 1..635: note = Synthetic polynucleotide
  misc_feature 1..635: note = delta-nifL::Prm6.1
  source 1..635: mol_type = other DNA
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggaattttttttcacaaagcgtagcgttattgaatcgcacattttaaactgttggccgctgtggaagcgaatattggtgaaaggtgcggttttaaggcctttttctttgactctctgtcgttacaaagttaatatgcgcgccctccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 215 - DNA, 1635 bp, synthetic construct
  misc_feature 1..1635: note = Synthetic polynucleotide
  misc_feature 1..1635: note = delta-nifL::Prm6.1 with 500bp flank
  source 1..1635: mol_type = other DNA
tgtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggaattttttttcacaaagcgtagcgttattgaatcgcacattttaaactgttggccgctgtggaagcgaatattggtgaaaggtgcggttttaaggcctttttctttgactctctgtcgttacaaagttaatatgcgcgccctccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtc

SEQ ID NO: 216 - DNA, 635 bp, synthetic construct; identical to SEQ ID NO: 214
  misc_feature 1..635: note = Synthetic polynucleotide
  misc_feature 1..635: note = delta-nifL::Prm6.1
  source 1..635: mol_type = other DNA

SEQ ID NO: 217 - DNA, 1635 bp, synthetic construct; identical to SEQ ID NO: 215
  misc_feature 1..1635: note = Synthetic polynucleotide
  misc_feature 1..1635: note = delta-nifL::Prm6.1 with 500bp flank
  source 1..1635: mol_type = other DNA

SEQ ID NO: 218 - DNA, 786 bp, synthetic construct
  misc_feature 1..786: note = Synthetic polynucleotide
  misc_feature 1..786: note = delta-nifL::Prm7.1
  source 1..786: mol_type = other DNA
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggttaaaaacgtgaccacgagcattaataaacgccacgaaatgtggcgtttatttattcaaaaagtatcttctttcataaaaagtgctaaatgcagtagcagcaaaattgggataagtcccatggaatacggctgttttcgctgcaatttttaactttttcgtaaaaaaagatgtttctttgagcgaacgatcaaaatatagcgttaaccggcaaaaaattattctcattagaaaatagtttgtgtaatacttgtaacgctacatggagattaacttaatctagagggttttataccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 219 - DNA, 1786 bp, synthetic construct
  misc_feature 1..1786: note = Synthetic polynucleotide
  misc_feature 1..1786: note = delta-nifL::Prm7.1 with 500bp flank
  source 1..1786: mol_type = other DNA
gtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggttaaaaacgtgaccacgagcattaataaacgccacgaaatgtggcgtttatttattcaaaaagtatcttctttcataaaaagtgctaaatgcagtagcagcaaaattgggataagtcccatggaatacggctgttttcgctgcaatttttaactttttcgtaaaaaaagatgtttctttgagcgaacgatcaaaatatagcgttaaccggcaaaaaattattctcattagaaaatagtttgtgtaatacttgtaacgctacatggagattaacttaatctagagggttttataccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtcg

SEQ ID NO: 220 - DNA, 993 bp, synthetic construct
  misc_feature 1..993: note = Synthetic polynucleotide
  misc_feature 1..993: note = delta-nifL::Prm1.2
  source 1..993: mol_type = other DNA
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggtgaacatcactgatgcacaagctacctatgtcgaagaattaactaaaaaactgcaagatgcaggcattcgcgttaaagccgacttgagaaatgagaagattggctttaaaattcgcgaacacacgctacgccgtgttccttatatgttagtttgtggcgataaagaggtcgaagcaggcaaagttgctgttcgtacccgccgcggcaaagacttaggaagcatggatgttagcgaagtcgttgacaaactgctggcggaaatccgcagcagaagtcttcatcaactggaggaataaagtattaaaggcggaaaacgagttcaaccggcgcgtcctaatcgcattaacaaagagattcgcgcgcaagaagttcgcctcacaggcgtcgatggcgagcagattggtattgtcagtctgaatgaagctcttgaaaaagctgaggaagcgggcgtcgatttagtagaaatcagtccgaatgccgagccgccagtttgtcgaatcccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 221 - DNA, 1993 bp, synthetic construct
  misc_feature 1..1993: note = Synthetic polynucleotide
  misc_feature 1..1993: note = delta-nifL::Prm1.2 with 500bp flank
  source 1..1993: mol_type = other DNA
tgtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggtgaacatcactgatgcacaagctacctatgtcgaagaattaactaaaaaactgcaagatgcaggcattcgcgttaaagccgacttgagaaatgagaagattggctttaaaattcgcgaacacacgctacgccgtgttccttatatgttagtttgtggcgataaagaggtcgaagcaggcaaagttgctgttcgtacccgccgcggcaaagacttaggaagcatggatgttagcgaagtcgttgacaaactgctggcggaaatccgcagcagaagtcttcatcaactggaggaataaagtattaaaggcggaaaacgagttcaaccggcgcgtcctaatcgcattaacaaagagattcgcgcgcaagaagttcgcctcacaggcgtcgatggcgagcagattggtattgtcagtctgaatgaagctcttgaaaaagctgaggaagcgggcgtcgatttagtagaaatcagtccgaatgccgagccgccagtttgtcgaatcccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtc

SEQ ID NO: 222 - DNA, 993 bp, synthetic construct; identical to SEQ ID NO: 220
  misc_feature 1..993: note = Synthetic polynucleotide
  misc_feature 1..993: note = delta-nifL::Prm1.2
  source 1..993: mol_type = other DNA

SEQ ID NO: 223 - DNA, 1993 bp, synthetic construct; identical to SEQ ID NO: 221
  misc_feature 1..1993: note = Synthetic polynucleotide
  misc_feature 1..1993: note = delta-nifL::Prm1.2 with 500bp flank
  source 1..1993: mol_type = other DNA

SEQ ID NO: 224 - DNA, 1188 bp, synthetic construct; identical to SEQ ID NO: 212
  misc_feature 1..1188: note = Synthetic polynucleotide
  misc_feature 1..1188: note = glnE-delta-AR-2
  source 1..1188: mol_type = other DNA

SEQ ID NO: 225 - DNA, 2188 bp, synthetic construct; identical to SEQ ID NO: 213
  misc_feature 1..2188: note = Synthetic polynucleotide
  misc_feature 1..2188: note = glnE-delta-AR-2 with 500bp flank
  source 1..2188: mol_type = other DNA

SEQ ID NO: 226 - DNA, 663 bp, synthetic construct
  misc_feature 1..663: note = Synthetic polynucleotide
  misc_feature 1..663: note = delta-nifL::Prm3.1
  source 1..663: mol_type = other DNA
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggtacagtagcgcctctcaaaaatagataaacggctcatgtacgtgggccgtttattttttctacccataatcgggaaccggtgttataatgccgcgccctcatattgtggggatttcttaatgacctatcctgggtcctaaagttgtagttgacattagcggagcactaacccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 227 - DNA, 1663 bp, synthetic construct
  misc_feature 1..1663: note = Synthetic polynucleotide
  misc_feature 1..1663: note = delta-nifL::Prm3.1 with 500bp flank
  source 1..1663: mol_type = other DNA
tgtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggtacagtagcgcctctcaaaaatagataaacggctcatgtacgtgggccgtttattttttctacccataatcgggaaccggtgttataatgccgcgccctcatattgtggggatttcttaatgacctatcctgggtcctaaagttgtagttgacattagcggagcactaacccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtc

SEQ ID NO: 228 - DNA, 1188 bp, synthetic construct; identical to SEQ ID NO: 212
  misc_feature 1..1188: note = Synthetic polynucleotide
  misc_feature 1..1188: note = glnE-delta-AR-2
  source 1..1188: mol_type = other DNA

SEQ ID NO: 229 - DNA, 2188 bp, synthetic construct; identical to SEQ ID NO: 213
  misc_feature 1..2188: note = Synthetic polynucleotide
  misc_feature 1..2188: note = glnE-delta-AR-2 with 500bp flank
  source 1..2188: mol_type = other DNA

SEQ ID NO: 230 - DNA, 613 bp, synthetic construct
  misc_feature 1..613: note = Synthetic polynucleotide
  misc_feature 1..613: note = delta-nifL::PinfC
  source 1..613: mol_type = other DNA
atgagcatcacggcgttatcagctgaatatcactgactcacaagctacctatgtcgaagaattaactaaaaaactgcaagatgcaggcattcgcgttaaagccgacttgagaaatgagaagattggctttaaaattcgcgaacacacgctacgccgtgttccttatatgttagtttgtggcgataaagaggtcgaagcaggcaaagttgctgttcgtactcgtcgcggcaaagacttaggaagcatggatgttagcgaagtcgttgacaaactgctggcggaaatccgcagcagaagtcatcatcaactggaggaataaagtattaaaggcggaaaacgagttcaaccggcgcgtcctaatcgcattaacaaagagattcgcgcgcaagaagttcgcctcaccggcgtcgatggcgagcagattggtattgtcagtctgaatgaagctcttgaaaaagctgaggaagcgggcgtcgatttagtagaaatcagtccgaatgccgagccgccagtttgtcgaatctctttagatctctcggtccgccctgatggcggcaccttgctgacgttacgcctgccggtacagcaggttatcaccggaggcttaaaatga

SEQ ID NO: 231 - DNA, 1613 bp, synthetic construct
  misc_feature 1..1613: note = Synthetic polynucleotide
  misc_feature 1..1613: note = delta-nifL::PinfC with 500bp flank
  source 1..1613: mol_type = other DNA
tgtttcgtctcgaagccgggcaactgagcagccccgttgaaaccgaactgggctggcatctgttgttgtgcgaacaaattcgcctgccgcaacccttgccgaaagccgaggccttaacgcgggtgcgtcagcaactgattgcccggcaacagaatcattatcagcgccagtggctgcaacaactgatcaacgcctgagcctgttctccttcttgttggtgcagacgggttaatgcccgttttgcacgaaaaatgcacataaactgccttcgctgccttataacagcgcatggaaatcctgcctcctgccttgtgccacgccgcgctttgcctggtttgtggtaaaaactggcccgctttgcatcctgatgtttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagctgaatatcactgactcacaagctacctatgtcgaagaattaactaaaaaactgcaagatgcaggcattcgcgttaaagccgacttgagaaatgagaagattggctttaaaattcgcgaacacacgctacgccgtgttccttatatgttagtttgtggcgataaagaggtcgaagcaggcaaagttgctgttcgtactcgtcgcggcaaagacttaggaagcatggatgttagcgaagtcgttgacaaactgctggcggaaatccgcagcagaagtcatcatcaactggaggaataaagtattaaaggcggaaaacgagttcaaccggcgcgtcctaatcgcattaacaaagagattcgcgcgcaagaagttcgcctcaccggcgtcgatggcgagcagattggtattgtcagtctgaatgaagctcttgaaaaagctgaggaagcgggcgtcgatttagtagaaatcagtccgaatgccgagccgccagtttgtcgaatctctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaataccgcgcgcgcactggcggcgatcctcgaagtgcttcacgatcatgcatttatgcaatacggcatggtgtgtctgttcgataaagaacgcaatgcactgtttgtggaatccctgcatggcatcgacggcgaaaggaaaaaagaaacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgctgattggtgtgccgatccccggtgcggataatcagcctgcgggtgtgctggtggcacagccgatggcgttgcacgaagaccggctggctgccagtacgcggtttttagaaatggtc

SEQ ID NO: 232 - DNA, 426 bp, synthetic construct; identical to SEQ ID NO: 38
  misc_feature 1..426: note = Synthetic polynucleotide
  misc_feature 1..426: note = delta-nifL::Prm5
  source 1..426: mol_type = other DNA

SEQ ID NO: 233 - DNA, 1426 bp, synthetic construct
  misc_feature 1..1426: note = Synthetic polynucleotide
  misc_feature 1..1426: note = delta-nifL::Prm5 with 500bp flank
  source 1..1426: mol_type = other DNA
accggatacgagagaaaagtgtctacatcggttcggttgatattgaccggcgcatccgccagcccgcccagtttctggtggatctgtttggcgattttgcgggtcttgccggtgtcggtgccgaaaaaaataccaatatttgccataacacacgctcctgttgaaaaagagatcccgccgggaaatgcggtgaacgtgtctgatattgcgaagagtgtgccagttttggtcgcgggcaaaacctgcaccagtttggttattaatgcaccagtctggcgctttttttcgccgagtttctcctcgctaatgcccgccaggcgcggctttggcgctgatagcgcgctgaataccgatctggatcaaggttttgtcgggttatcagccaaaaggtgcactctttgcatggttatacgtgcctgacatgttgtccgggcgacaaacggcctggtggcacaaattgtcagaactacgacacgactaactgaccgcaggagtgtgcgatgaccctgaatatgatgatggatgccggcggacatcatcgcgacaaacaatattaataccggcaaccacaccggcaatttacgagactgcgcaggcatcctttctcccgtcaatttctgtcaaataaagtaaaagaggcagtctacttgaattacccccggctggttgagcgtttgttgaaaaaaagtaactgaaaaatccgtagaatagcgccactctgatggttaattaacctattcaattaagaattatctggatgaatgtgccattaaatgcgcagcataatggtgcgttgtgcgggaaaactgcttttttttgaaagggttggtcagtagcggaaacaactcacttcacaccccgaagggggaagttgcctgaccctacgattcccgctatttcattcactgaccggaggttcaaaatgacccagcgaaccgagtcgggtaataccgtctggcgcttcgatttgtcccagcagttcactgcgatgcagcgcataagcgtggtactcagccgggcgaccgaggtcgatcagacgctccagcaagtgctgtgcgtattgcacaatgacgcctttttgcagcacggcatgatctgtctgtacgacagccagcaggcgattttgaatattgaagcgttgcaggaagccgatcagcagttaatccccggcagctcgcaaatccgctatcgtccgggcgaagggctggtcgggacggtgctttcgcagggccaatcattagtgctggcgcgcgttgctgacgatcagcgctttcttgaccggctcgggttgtatgattacaacctgccgtttatcgccgtgccgctgatagggccagatgcgcagactttcggtgtgctgacggcacaacccatggcgcgttacgaagagcgattacccgcctgcacccgctttctggaaacggtc

SEQ ID NO: 234 - DNA, 461 bp, synthetic construct; identical to SEQ ID NO: 41
  misc_feature 1..461: note = Synthetic polynucleotide
  misc_feature 1..461: note = delta-nifL::Prm1
  source 1..461: mol_type = other DNA

SEQ ID NO: 235 - DNA, 1461 bp, synthetic construct
  misc_feature 1..1461: note = Synthetic polynucleotide
  misc_feature 1..1461: note = delta-nifL::Prm1 with 500bp flank
  source 1..1461: mol_type = other DNA
accggatacgagagaaaagtgtctacatcggttcggttgatattgaccggcgcatccgccagcccgcccagtttctggtggatctgtttggcgattttgcgggtcttgccggtgtcggtgccgaaaaaaataccaatatttgccataacacacgctcctgttgaaaaagagatcccgccgggaaatgcggtgaacgtgtctgatattgcgaagagtgtgccagttttggtcgcgggcaaaacctgcaccagtttggttattaatgcaccagtctggcgctttttttcgccgagtttctcctcgctaatgcccgccaggcgcggctttggcgctgatagcgcgctgaataccgatctggatcaaggttttgtcgggttatcagccaaaaggtgcactctttgcatggttatacgtgcctgacatgttgtccgggcgacaaacggcctggtggcacaaattgtcagaactacgacacgactaactgaccgcaggagtgtgcgatgaccctgaatatgatgatggatgccggccgtcctgtaataataaccggacaattcggactgattaaaaaagcgcccttgtggcgctttttttatattcccgcctccatttaaaataaaaaatccaatcggatttcactatttaaactggccattatctaagatgaatccgatggaagctcgctgttttaacacgcgttttttaaccttttattgaaagtcggtgcttctttgagcgaacgatcaaatttaagtggattcccatcaaaaaaatattctcaacctaaaaaagtttgtgtaatacttgtaacgctacatggagattaactcaatctagagggtattaataatgaatcgtactaaactggtactgggcgcaactcacttcacaccccgaagggggaagttgcctgaccctacgattcccgctatttcattcactgaccggaggttcaaaatgacccagcgaaccgagtcgggtaataccgtctggcgcttcgatttgtcccagcagttcactgcgatgcagcgcataagcgtggtactcagccgggcgaccgaggtcgatcagacgctccagcaagtgctgtgcgtattgcacaatgacgcctttttgcagcacggcatgatctgtctgtacgacagccagcaggcgattttgaatattgaagcgttgcaggaagccgatcagcagttaatccccggcagctcgcaaatccgctatcgtccgggcgaagggctggtcgggacggtgctttcgcagggccaatcattagtgctggcgcgcgttgctgacgatcagcgctttcttgaccggctcgggttgtatgattacaacctgccgtttatcgccgtgccgctgatagggccagatgcgcagactttcggtgtgctgacggcacaacccatggcgcgttacgaagagcgattacccgcctgcacccgctttctggaaacggtc

SEQ ID NO: 236 - DNA, 461 bp, synthetic construct; identical to SEQ ID NO: 41
  misc_feature 1..461: note = Synthetic polynucleotide
  misc_feature 1..461: note = delta-nifL::Prm1
  source 1..461: mol_type = other DNA

SEQ ID NO: 237 - DNA, 1461 bp, synthetic construct; identical to SEQ ID NO: 235
  misc_feature 1..1461: note = Synthetic polynucleotide
  misc_feature 1..1461: note = delta-nifL::Prm1 with 500bp flank
  source 1..1461: mol_type = other DNA

SEQ ID NO: 238 - DNA, 1188 bp, synthetic construct
  misc_feature 1..1188: note = Synthetic polynucleotide
  misc_feature 1..1188: note = glnE-delta-AR-2
  source 1..1188: mol_type = other DNA
atggcactgaaacacctcatttccctgtgtgccgcgtcgccgatggttgccagtcagctggcgcgctacccgatcctgcttgatgaattgctcgacccgaatacgctctatcaaccgacggcgatgaatgcctatcgcgatgagctgcgccaatacctgctgcgcgtgccggaagatgatgaagagcaacagcttgaggcgctgcggcagtttaagcaggcgcagttgctgcgcgtggcggcggcggatattgccggtacgttgccagtaatgaaagtgagcgatcacttaacctggctggcggaagcgattattgatgcggtggtgcagcaagcctgggggcagatggtggcgcgttatggccagccaacgcatctgcacgatcgcgaagggcgcggttttgcggtggtcggttatggcaagctgggcggctgggagctgggttacagctccgatctggatctggtattcctgcacgactgcccgatggatgtgatgaccgatggcgagcgtgaaatcgatggtcgccagttctatttgcgtctcgcgcagcgcgtgatgcacctgtttagcacgcgcacgtcgtccggcatcctttatgaagttgatgcgcgtctgcgtccatctggcgctgcggggatgctggtcactactacggaatcgttcgccgattaccagcaaaacgaagcctggacgtgggaacatcaggcgctggcccgtgcgcgcgtggtgtacggcgatccgcaactgaccgccgaatttgacgccattcgccgcgatattctgatgacgcctcgcgacggcgcaacgctgcaaaccgacgtgcgagaaatgcgcgagaaaatgcgtgcccatcttggcaacaagcataaagaccgcttcgatctgaaagccgatgaaggcggtatcaccgacatcgagtttatcgcccaatatctggtgctgcgctttgcccatgacaagccgaaactgacgcgctggtcggataatgtgcgcattctcgaagggctggcgcaaaacggcatcatggaggagcaggaagcgcaggcattgacgctggcgtacaccacattgcgtgatgagctgcaccacctggcgctgcaagagttgccgggacatgtggcgctctcctgttttgtcgccgagcgtgcgcttattaaaaccagctgggacaagtggctggtggaa

SEQ ID NO: 239 - DNA, 2206 bp, synthetic construct
  misc_feature 1..2206: note = Synthetic polynucleotide
  misc_feature 1..2206: note = glnE-delta-AR-2 with 500bp flank
  source 1..2206: mol_type = other DNA
gcgcaaagcgagtgctcacttacgtgatctgttgacacaatctgaagcgaccataacttctgccgtttcagcgaatacggcggtgtggagcgcacaatcagccctggcgaagctggtgctcaccgagtggctagtgacgcagggctggcgaaccttccttgatgaaaaagcgcaggccaaattcgccgactcctttaaacgctttgctgacatccatctgtcacgcagcgccgccgagctgaaaaaagcctttgcccaaccgctgggcgacagctatcgcgaccagttgccgcgcctggcgcgtgatatcgactgcgcgttactgctggccgggcattacgatcgcgcgcgcgccgtggaatggctggaaaactggcaggggcttcagcacgccattgaaacgcgccagagagtcgaaatcgaacatttccgtaataccgcgattacccaggagccgttctggttgcacagcggaaaacgttaacgaaaggatatttcgcatggcactgaaacacctcatttccctgtgtgccgcgtcgccgatggttgccagtcagctggcgcgctacccgatcctgcttgatgaattgctcgacccgaatacgctctatcaaccgacggcgatgaatgcctatcgcgatgagctgcgccaatacctgctgcgcgtgccggaagatgatgaagagcaacagcttgaggcgctgcggcagtttaagcaggcgcagttgctgcgcgtggcggcggcggatattgccggtacgttgccagtaatgaaagtgagcgatcacttaacctggctggcggaagcgattattgatgcggtggtgcagcaagcctgggggcagatggtggcgcgttatggccagccaacgcatctgcacgatcgcgaagggcgcggttttgcggtggtcggttatggcaagctgggcggctgggagctgggttacagctccgatctggatctggtattcctgcacgactgcccgatggatgtgatgaccgatggcgagcgtgaaatcgatggtcgccagttctatttgcgtctcgcgcagcgcgtgatgcacctgtttagcacgcgcacgtcgtccggcatcctttatgaagttgatgcgcgtctgcgtccatctggcgctgcggggatgctggtcactactacggaatcgttcgccgattaccagcaaaacgaagcctggacgtgggaacatcaggcgctggcccgtgcgcgcgtggtgtacggcgatccgcaactgaccgccgaatttgacgccattcgccgcgatattctgatgacgcctcgcgacggcgcaacgctgcaaaccgacgtgcgagaaatgcgcgagaaaatgcgtgcccatcttggcaacaagcataaagaccgcttcgatctgaaagccgatgaaggcggtatcaccgacatcgagtttatcgcccaatatctggtgctgcgctttgcccatgacaagccgaaactgacgcgctggtcggataatgtgcgcattctcgaagggctggcgcaaaacggcatcatggaggagcaggaagcgcaggcattgacgctggcgtacaccacattgcgtgatgagctgcaccacctggcgctgcaagagttgccgggacatgtggcgctctcctgttttgtcgccgagcgtgcgcttattaaaaccagctgggacaagtggctggtggaaccgtgcgccccggcgtaagtgtggtatcatcgcgcgcaaattttgtatctctcaggagacaggaatgaaagtgacgctgccagagtttaagcaagccggtgtaatggtggtgggtgatgtgatgctggatcgttactggtatggcccaaccagccgtatctctccggaagcgccagtcccggttgttaaagtcgataccattgaagagcgtcctggcggcgcggcaaacgtggcgatgaatatcgcctcactgggcgccacggcgcgtctggttggcctgactggcattgacgatgcggcgcgcgcgctgagcaaagcgctggccgatgttaacgttaaatgtgacttcgtttctgttccgacgcatcccaccatcactaagctgcgcgtgctgtcgcgtaaccagcagctgattcgcctggactttgaagagggttttgaaggagtcgatccgcaaccgatgcatgaacgcatcagccaggcgcttggtaatattggcgcgctggtgctgtcggatt

SEQ ID NO: 240 - DNA, 1563 bp, synthetic construct; identical to SEQ ID NO: 61
  misc_feature 1..1563: note = Synthetic polynucleotide
  misc_feature 1..1563: note = glnE-delta-AR-1
  source 1..1563: mol_type = other DNA

SEQ ID NO: 241 - DNA, 461 bp, synthetic construct; identical to SEQ ID NO: 41
  misc_feature 1..461: note = Synthetic polynucleotide
  misc_feature 1..461: note = delta-nifL::Prm1
  source 1..461: mol_type = other DNA

SEQ ID NO: 242 - DNA, 1461 bp, synthetic construct; identical to SEQ ID NO: 235
  misc_feature 1..1461: note = Synthetic polynucleotide
  misc_feature 1..1461: note = delta-nifL::Prm1 with 500bp flank
  source 1..1461: mol_type = other DNA

SEQ ID NO: 243 - DNA, 2563 bp, synthetic construct
  misc_feature 1..2563: note = Synthetic polynucleotide
  misc_feature 1..2563: note = glnE-delta-AR-1 with 500bp flank
  source 1..2563: mol_type = other DNA
gcgcaaagcgagtgctcacttacgtgatctgttgacacaatctgaagcgaccataacttctgccgtttcagcgaatacggcggtgtggagcgcacaatcagccctggcgaagctggtgctcaccgagtggctagtgacgcagggctggcgaaccttccttgatgaaaaagcgcaggccaaattcgccgactcctttaaacgctttgctgacatccatctgtcacgcagcgccgccgagctgaaaaaagcctttgcccaaccgctgggcgacagctatcgcgaccagttgccgcgcctggcgcgtgatatcgactgcgcgttactgctggccgggcattacgatcgcgcgcgcgccgtggaatggctggaaaactggcaggggcttcagcacgccattgaaacgcgccagagagtcgaaatcgaacatttccgtaataccgcgattacccaggagccgttctggttgcacagcggaaaacgttaacgaaaggatatttcgcatgtttaacgatctgattggcgatgatgaaacggattcgccggaagatgcgctttctgagagctggcgcgaattgtggcaggatgcgttgcaggaggaggattccacgcccgtgctggcgcatctctcagaggacgatcgccgccgcgtggtggcgctgattgccgattttcgcaaagagttggataaacgcaccattggcccgcgagggcggcaggtactcgatcacttaatgccgcatctgctcagcgatgtatgctcgcgcgacgatgcgccagtaccgctgtcacgcctgacgccgctgctcaccggaattattacccgcaccacttaccttgagctgctaagtgaatttcccggcgcactgaaacacctcatttccctgtgtgccgcgtcgccgatggttgccagtcagctggcgcgctacccgatcctgcttgatgaattgctcgacccgaatacgctctatcaaccgacggcgatgaatgcctatcgcgatgagctgcgccaatacctgctgcgcgtgccggaagatgatgaagagcaacagcttgaggcgctgcggcagtttaagcaggcgcagttgctgcgcgtggcggcggcggatattgccggtacgttgccagtaatgaaagtgagcgatcacttaacctggctggcggaagcgattattgatgcggtggtgcagcaagcctgggggcagatggtggcgcgttatggccagccaacgcatctgcacgatcgcgaagggcgcggttttgcggtggtcggttatggcaagctgggcggctgggagctgggttacagctccgatctggatctggtattcctgcacgactgcccgatggatgtgatgaccgatggcgagcgtgaaatcgatggtcgccagttctatttgcgtctcgcgcagcgcgtgatgcacctgtttagcacgcgcacgtcgtccggcatcctttatgaagttgatgcgcgtctgcgtccatctggcgctgcggggatgctggtcactactacggaatcgttcgccgattaccagcaaaacgaagcctggacgtgggaacatcaggcgctggcccgtgcgcgcgtggtgtacggcgatccgcaactgaccgccgaatttgacgccattcgccgcgatattctgatgacgcctcgcgacggcgcaacgctgcaaaccgacgtgcgagaaatgcgcgagaaaatgcgtgcccatcttggcaacaagcataaagaccgcttcgatctgaaagccgatgaaggcggtatcaccgacatcgagtttatcgcccaatatctggtgctgcgctttgcccatgacaagccgaaactgacgcgctggtcggataatgtgcgcattctcgaagggctggcgcaaaacggcatcatggaggagcaggaagcgcaggcattgacgctggcgtacaccacattgcgtgatgagctgcaccacctggcgctgcaagagttgccgggacatgtggcgctctcctgttttgtcgccgagcgtgcgcttattaaaaccagctgggacaagtggctggtggaaccgtgcgccccggcgtaagtgtggtatcatcgcgcgcaaattttgtatctctcaggagacaggaatgaaagtgacgctgccagagtttaagcaagccggtgtaatggtggtgggtgatgtgatgctggatcgttactggtatggcccaaccagccgtatctctccggaagcgccagtcccggttgttaaagtcgataccattgaagagcgtcctggcggcgcggcaaacgtggcgatgaatatcgcctcactgggcgccacggcgcgtctggttggcctgactggcattgacgatgcggcgcgcgcgctgagcaaagcgctggccgatgttaacgttaaatgtgacttcgtttctgttccgacgcatcccaccatcactaagctgcgcgtgctgtcgcgtaaccagcagctgattcgcctggactttgaagagggttttgaaggagtcgatccgcaaccgatgcatgaacgcatcagccaggcgcttggtaatattggcgcgctggtgctgtcggatt

SEQ ID NO: 244 - DNA, 1563 bp, synthetic construct; identical to SEQ ID NO: 61
  misc_feature 1..1563: note = Synthetic polynucleotide
  misc_feature 1..1563: note = glnE-delta-AR-1
  source 1..1563: mol_type = other DNA

SEQ ID NO: 245 - DNA, 2563 bp, synthetic construct; identical to SEQ ID NO: 243
  misc_feature 1..2563: note = Synthetic polynucleotide
  misc_feature 1..2563: note = glnE-delta-AR-1 with 500bp flank
  source 1..2563: mol_type = other DNA

SEQ ID NO: 246 - DNA, 426 bp, synthetic construct; identical to SEQ ID NO: 38
  misc_feature 1..426: note = Synthetic polynucleotide
  misc_feature 1..426: note = delta-nifL::Prm5
  source 1..426: mol_type = other DNA

SEQ ID NO: 247 - DNA, 1426 bp, synthetic construct; identical to SEQ ID NO: 233
  misc_feature 1..1426: note = Synthetic polynucleotide
  misc_feature 1..1426: note = delta-nifL::Prm5 with 500bp flank
  source 1..1426: mol_type = other DNA

SEQ ID NO: 248 - DNA, 461 bp, synthetic construct; identical to SEQ ID NO: 41
  misc_feature 1..461: note = Synthetic polynucleotide
  misc_feature 1..461: note = delta-nifL::Prm1
  source 1..461: mol_type = other DNA

SEQ ID NO: 249 - DNA, 1461 bp, synthetic construct; identical to SEQ ID NO: 235
  misc_feature 1..1461: note = Synthetic polynucleotide
  misc_feature 1..1461: note = delta-nifL::Prm1 with 500bp flank
  source 1..1461: mol_type = other DNA

SEQ ID NO: 250 - DNA, 1188 bp, synthetic construct; identical to SEQ ID NO: 238
  misc_feature 1..1188: note = Synthetic polynucleotide
  misc_feature 1..1188: note = glnE-delta-AR-2
  source 1..1188: mol_type = other DNA

SEQ ID NO: 251 - DNA, 2206 bp, synthetic construct; identical to SEQ ID NO: 239
  misc_feature 1..2206: note = Synthetic polynucleotide
  misc_feature 1..2206: note = glnE-delta-AR-2 with 500bp flank
  source 1..2206: mol_type = other DNA

SEQ ID NO: 252 - DNA, 199 bp, synthetic construct
  misc_feature 1..199: note = Synthetic polynucleotide
  misc_feature 1..199: note = delta-amtB
  source 1..199: mol_type = other DNA
tttcgctgaaggtgtgaccatgggccatcaggtgctggtgcagctggaaagtgttgccatcactatcgtgtggtctggcgtggtggcctttattggttacaaactggcggacatgacggtaggcctgcgcgtaccggaagaacaagaacgtgaagggctggatgtaaacagccacggcgaaaacgcctataacgcctga

SEQ ID NO: 253 - DNA, 1199 bp, synthetic construct
  misc_feature 1..1199: note = Synthetic polynucleotide
  misc_feature 1..1199: note = delta-amtB with 500bp flank
  source 1..1199: mol_type = other DNA
tttcctttctgactctgcccgtccgggcgcactaacggcctgaaatactccctcttttcattcctggcacaacgattgcaatgtctgttgcgtgttagctgcggccattatcgaattcgactggagggggatctatgaagctggttaccgtggtgattaagccattcaaacttgaagacgtgcgtgaagcgctttcttctattggtattcaagggttgaccgtaactgaagtgaaaggctttggccgtcagaagggtcacgctgagctgtaccgcggtgcggaatatagcgttaatttcctgccgaaagtgaaaattgatgtggcgatcgctgacgatcaactcgatgaagtaatcgatgtgatcagcaaagcggcctacaccggaaaaattggcgacggcaaaattttcgttgctgagctgcaacgcgtcattcgtattcgtaccggcgaagccgacgaagcggcactgtaatacaagacacacagtgatggggatcggtttcgctgaaggtgtgaccatgggccatcaggtgctggtgcagctggaaagtgttgccatcactatcgtgtggtctggcgtggtggcctttattggttacaaactggcggacatgacggtaggcctgcgcgtaccggaagaacaagaacgtgaagggctggatgtaaacagccacggcgaaaacgcctataacgcctgattgcgttgagttatctcctgagcataaaaaagcctccattcggaggcttttctttttttaagtttaaagcgcggttagttgcgattgcgcatgacgccttcctgcacgctggacgcgaccagcacaccctcttgcgtatagaactcgccgcgcacaaaaccgcgagcgctggaggctgacgtgctttccacactgtagagcagccattcgttcatattaaacgggcgatggaaccacatggagtggtcaatggtggcaacctgcataccgcgctcaaggaagcccacgccgtgcggctgaagtgcaaccggcaggaagttaaagtctgaggcatatccaagcagatattgatgtacgcgaaaatcgtccggcaccgtgccgtttgcgcggatccatacctggcgggtgggatcggcaacgtggcctttcagcgggttatgaaactcaaccgggcggatctccagtggtttatcactaagaaacttctctttggcctgcgg

SEQ ID NO: 254 - DNA, 1563 bp, synthetic construct; identical to SEQ ID NO: 61
  misc_feature 1..1563: note = Synthetic polynucleotide
  misc_feature 1..1563: note = glnE-delta-AR-1
  source 1..1563: mol_type = other DNA

SEQ ID NO: 255 - DNA, 2563 bp, synthetic construct; identical to SEQ ID NO: 243
  misc_feature 1..2563: note = Synthetic polynucleotide
  misc_feature 1..2563: note = glnE-delta-AR-1 with 500bp flank
  source 1..2563: mol_type = other DNA

SEQ ID NO: 256 - DNA, 461 bp, synthetic construct; identical to SEQ ID NO: 41
  misc_feature 1..461: note = Synthetic polynucleotide
  misc_feature 1..461: note = delta-nifL::Prm1
  source 1..461: mol_type = other DNA

SEQ ID NO: 257 - DNA, 1461 bp, synthetic construct; identical to SEQ ID NO: 235
  misc_feature 1..1461: note = Synthetic polynucleotide
  misc_feature 1..1461: note = delta-nifL::Prm1 with 500bp flank
  source 1..1461: mol_type = other DNA

SEQ ID NO: 258 - DNA, 199 bp, synthetic construct; identical to SEQ ID NO: 252
  misc_feature 1..199: note = Synthetic polynucleotide
  misc_feature 1..199: note = delta-amtB
  source 1..199: mol_type = other DNA

SEQ ID NO: 259 - DNA, 1199 bp, synthetic construct; identical to SEQ ID NO: 253
  misc_feature 1..1199: note = Synthetic polynucleotide
  misc_feature 1..258: note = delta-amtB with 500bp flank
  source 1..1199: mol_type = other DNA

SEQ ID NO: 260 - DNA, 607 bp, synthetic construct
  misc_feature 1..607: note = Synthetic polynucleotide
  misc_feature 1..607: note = delta-nifL::PinfC
  source 1..607: mol_type = other DNA
atgacctttaatatgatgcctggggtcactggagcgctttatcggcatcctgaccgaagaatttgccggtttcttcccgacctggctggcccctgttcaggttgtggtgatgaatatcactgattctcaagctgaatatgtcaacgaattgacccgtaaattgcaaaatgcgggcattcgtgtaaaagcggacttgagaaacgagaagattggctttaaaatccgcgagcacactttacgtcgtgtcccttatatgttggtctgtggtgataaagaggtggaagcaggcaaagtggccgttcgcacccgccgcggtaaagacctgggcagcctggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgcccaggaagttcgcttaactggtctggaaggtgagcagctgggtattgcaatagaactaactacccgccctgaaggcggtacctgcctgaccctgcgattcccgttatttcattcactgaccggaggcccacgatga

SEQ ID NO: 261 - DNA, 1607 bp, synthetic construct
  misc_feature 1..1607: note = Synthetic polynucleotide
  misc_feature 1..1607: note = delta-nifL::PinfC with 500bp flank
  source 1..1607: mol_type = other DNA
ggtacgacaaaaacgtctccagcgacgtgcggttaatattgactggcgcatccgccacatcccccagtttttgctggatcagtttggcgattttgcgggtttttcccgtgtcactgccaaaaaaaataccaatgttagccatgtcgcgctcctgttgagaaagaataaggccgcctgcaaacggcggatatcccttctcctgttgcgaaggctgtgccaggtttttttaaggccttctgtgcactgaaatgggtgaaaaaatgactcttttttgtgcaggcaccgtcctctctccgctatccagacctgctttgaaggcctctgagggccaaatcagggccaaaacacgaatcaggatcaatgtttcggcgcgttacctgttcgaaaggtgcactctttgcatggttaatcacacccaatcagggctgcggatgtcgggcgtttcacaacacaaaatgttgtaaatgcgacacagccgggcctgaaaccaggagcgtgtgatgacctttaatatgatgcctggggtcactggagcgctttatcggcatcctgaccgaagaatttgccggtttcttcccgacctggctggcccctgttcaggttgtggtgatgaatatcactgattctcaagctgaatatgtcaacgaattgacccgtaaattgcaaaatgcgggcattcgtgtaaaagcggacttgagaaacgagaagattggctttaaaatccgcgagcacactttacgtcgtgtcccttatatgttggtctgtggtgataaagaggtggaagcaggcaaagtggccgttcgcacccgccgcggtaaagacctgggcagcctggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgcccaggaagttcgcttaactggtctggaaggtgagcagctgggtattgcaatagaactaactacccgccctgaaggcggtacctgcctgaccctgcgattcccgttatttcattcactgaccggaggcccacgatgacccagcgacccgagtcgggcaccaccgtctggcgttttgatctctcacagcaatttaccgccatgcagcgcatcagcgtggtgttgagtcgcgcaaccgagataagccagacgctgcaggaggtgctgtgtgttctgcataatgacgcatttatgcaacacggcatgctgtgtctgtatgacaaccagcaggaaattctgagtattgaagccttgcaggaggcagaccaacatctgatccccggcagctcgcaaattcgctatcgccctggcgaagggctggtaggagccgtactgtcccagggacaatctcttgtgctgccgcgtgtcgccgacgatcaacgctttctcgacaggcttggcatctatgattacaacctgccgtttatcgccgtccccttaatggggccaggcgcgcagacgattggcgtgctcgccgcgcagccgatggcgcgtctggaggagcggcttccttcctgtacgcgctttctggaaaccgtc

SEQ ID NO: 262 - DNA, 1536 bp, Kosakonia sacchari; identical to SEQ ID NO: 62
  gene 1..1536: note = 16S-1
  source 1..1536: mol_type = genomic DNA

SEQ ID NO: 263 - DNA, 1537 bp, Kosakonia sacchari; identical to SEQ ID NO: 63
  gene 1..1537: note = 16S-2
  variation 450: note = n is a, c, t, g, unknown or other
  variation 452: note = n is a, c, t, g, unknown or other
  variation 455: note = n is a, c, t, g, unknown or other
  variation 473: note = n is a, c, t, g, unknown or other
  source 1..1537: mol_type = genomic DNA

SEQ ID NO: 264 - DNA, 882 bp, Kosakonia sacchari; identical to SEQ ID NO: 65
  gene 1..882: note = nifH
  source 1..882: mol_type = genomic DNA

SEQ ID NO: 265 - DNA, 1449 bp, Kosakonia sacchari; identical to SEQ ID NO: 66
  gene 1..1449: note = nifD2
  source 1..1449: mol_type = genomic DNA

SEQ ID NO: 266 - DNA, 1563 bp, Kosakonia sacchari; identical to SEQ ID NO: 67
  gene 1..1563: note = nifK2
  source 1..1563: mol_type = genomic DNA

SEQ ID NO: 267 - DNA, 1488 bp, Kosakonia sacchari; identical to SEQ ID NO: 68
  gene 1..1488: note = nifL
  source 1..1488: mol_type = genomic DNA

SEQ ID NO: 268 - DNA, 1575 bp, Kosakonia sacchari; identical to SEQ ID NO: 69
  gene 1..1575: note = nifA
  source 1..1575: mol_type = genomic DNA

SEQ ID NO: 269 - DNA, 2850 bp, Kosakonia sacchari; identical to SEQ ID NO: 79
  gene 1..2850: note = glnE
  source 1..2850: mol_type = genomic DNA

SEQ ID NO: 270 - DNA, 1536 bp, Kosakonia sacchari
  gene 1..1536: note = 16S-3
  variation 766..776: note = n is a, c, t, g, unknown or other
  variation 905: note = n is a, c, t, g, unknown or other
  source 1..1536: mol_type = genomic DNA
attgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaagggagtaaggttaataaccttgctcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagagggaggtagaattccaggtgtagcggtgaaatgcgtagagatctggaggaataccggtggcgaaggcggcctcctggacgaagactgacgctcaggtgcgaaagnnnnnnnnnnnaacaggattagataccctggtagtccatgccgtaaacgatgtctactagccgttggggcctttgaggctttagtggcgcagctaacgcgataagtagaccgcctggggagtacggtcgcaagactaaanctcaaatgaattgacgggggcccgcacaagcggtggagcatgtggtttaattcgatgcaacgcgaagaaccttacctggccttgacatagtaagaattttccagagatggattggtgccttcgggaacttacatacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctccttt

SEQ ID NO: 271 - DNA, 882 bp, Kosakonia sacchari; identical to SEQ ID NO: 65
  gene 1..882: note = nifD1
  source 1..882: mol_type = genomic DNA

SEQ ID NO: 272 - DNA, 1386 bp, Kosakonia sacchari
  gene 1..1386: note = nifK1
  source 1..1386: mol_type = genomic DNA
atggccgaaattctgcgcagtaaaaaaccgctggcggtcagcccgataaaaagcggccagccgctgggggcgatcctcgcaagcctgggtgtcgaacagtgcataccgctggtacacggcgcacagggatgtagcgcgttcgcgaaggtgttctttattcaacattttcacgatccgatcccgctgcaatcgacggcgatggatccgacttccaccattatgggcgccgatgaaaacatttttaccgcgctcaatgtgctctgccagcgcaacgccgcgaaagccattgtgctgctcagcaccgggctttcagaagcccagggcagcgacatttcgcgggtggtgcgccagtttcgtgatgattttccccggcataaaggcgttgcgctgctcaccgtcaacacacccgatttctacggctcgctggaaaacggctacagcgccgtgctggaaagcatgattgaacagtgggtacccgcacagcccgccgccagcctgcgcaaccgccgtgtcaacctgctggtcagccatttactgacaccaggcgatatcgaactgttgcgcagttatgttgaagccttcggcctgcaaccggtgattgtgccggatctgtcgctgtcgctggacgggcatctggcagacggtgatttttcgcctgttacccaagggggaacatcgctgcgcatgattgaacagatggggcaaaacctggccacctttgtgattggcgcctcgctgggccgtgcggcggcgttactggcgcagcgcagccgtggcgaggtgatcgccctgccgcatctgatgacgcttgcagcctgcgacacgtttattcatcgactgaaaaccctctccgggcgcgatgtccccgcgtggattgagcgccagcgcggccaagttcaggatgcgatgatcgattgccatatgtggctgcagggtgcggctatcgccatggcagcagaaggcgatcacctggcggcatggtgcgatttcgcccgcagccagggcatgatccccggcccgattgtcgcaccggtcagccagccggggttgcaaaatctgccggttgaaaccgtggttatcggcgatctggaagatatgcaggatcggctttgcgcgacgcccgccgcgttactggtggccaattctcatgccgccgatctcgccacgcagtttgatttgtcacttatccgcgccgggttcccggtgtatgaccggctgggggaatttcgtcgcctgcgccaggggtacagcggcattcgtgacacgctgtttgagctggcgaatgtgatgcgcgagcgccatcacccgcttgcaacctaccgctcgccgctgcgccagcacgccgacgacaacgttacgcctggagatctgtatgccgcatgttaa

SEQ ID NO: 273 - DNA, 1287 bp, Kosakonia sacchari
  gene 1..1287: note = amtB
  source 1..1287: mol_type = genomic DNA
atgaaaaacacaacattaaaaacagcgcttgcttcgctggcgttactgcctggcctggcgatggcggctcccgctgtggcggataaagccgacaacggctttatgatgatttgcaccgcgctggtgctgtttatgaccattccgggcattgcgctgttctacggcggtttgatccgcggtaaaaacgtgctgtcgatgctgacgcaggttgccgtcaccttcgcactggtgtgcattctgtgggtggtgtatggctactcgctggcatttggcgagggcaacagcttcttcgggagttttaactgggcgatgttgaaaaacatcgaactgaaagccgtgatgggcagcatttatcagtatatccacgtggcgttccagggttccttcgcctgtatcaccgttggcctgattgtcggtgcactggctgagcgtattcgcttctctgcggtgctgatttttgtggtggtatggctgacgctttcttacgtgccgattgcacacatggtgtggggcggcggtctgctggcaacccacggtgcgctggatttcgcaggcggtacggttgttcacatcaacgctgcgattgcaggtctggtgggggcttacctgattggcaaacgcgtgggctttggcaaagaagcattcaaaccgcataacctgccgatggtcttcactggcaccgctatcctgtatgttggctggtttggtttcaacgccggctccgcaagctcggcgaacgaaattgctgcgctggccttcgtgaacactgtcgttgccactgctgccgctattctggcgtgggtatttggcgaatgggcaatgcgcggcaagccgtctctgctcggtgcctgttctggtgccatcgcgggtctggttggtatcacccccgcctgtggttatgtgggtgtcggcggtgcgctgattgtgggtctgattgccggtctggctgggctgtggggcgttactgcgctgaaacgtatgttgcgtgtcgatgacccgtgtgacgtattcggtgtgcacggcgtgtgcggcatcgtgggctgtatcctgacgggtatcttcgcctctacgtcgctgggtggtgtcggtttcgctgaaggtgtgaccatgggccatcaggtgctggtgcagctggaaagtgttgccatcactatcgtgtggtctggcgtggtggcctttattggttacaaactggcggacatgacggtaggcctgcgcgtaccggaagaacaagaacgtgaagggctggatgtaaacagccacggcgaaaacgcctataacgcctga

SEQ ID NO: 274 - DNA, 348 bp, Kosakonia sacchari
  gene 1..348: note = Prm1
  source 1..348: mol_type = genomic DNA
cgtcctgtaataataaccggacaattcggactgattaaaaaagcgcccttgtggcgctttttttatattcccgcctccatttaaaataaaaaatccaatcggatttcactatttaaactggccattatctaagatgaatccgatggaagctcgctgttttaacacgcgttttttaaccttttattgaaagtcggtgcttctttgagcgaacgatcaaatttaagtggattcccatcaaaaaaatattctcaacctaaaaaagtttgtgtaatacttgtaacgctacatggagattaactcaatctagagggtattaataatgaatcgtactaaactggtactgggcgc

SEQ ID NO: 275 - DNA, 313 bp, Kosakonia sacchari
  gene 1..313: note = Prm5
  source 1..313: mol_type = genomic DNA
ggacatcatcgcgacaaacaatattaataccggcaaccacaccggcaatttacgagactgcgcaggcatcctttctcccgtcaatttctgtcaaataaagtaaaagaggcagtctacttgaattacccccggctggttgagcgtttgttgaaaaaaagtaactgaaaaatccgtagaatagcgccactctgatggttaattaacctattcaattaagaattatctggatgaatgtgccattaaatgcgcagcataatggtgcgttgtgcgggaaaactgcttttttttgaaagggttggtcagtagcggaaac

SEQ ID NO: 276 - DNA, 1485 bp, Rahnella aquatilis; identical to SEQ ID NO: 103
  gene 1..1485: note = nifL
  source 1..1485: mol_type = genomic DNA

SEQ ID NO: 277 - DNA, 1575 bp, Rahnella aquatilis; identical to SEQ ID NO: 104
  gene 1..1575: note = nifA
  source 1..1575: mol_type = genomic DNA

SEQ ID NO: 278 - DNA, 1540 bp, Rahnella aquatilis
  gene 1..1540: note = 16S-1
  source 1..1540: mol_type = genomic DNA
attgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcatacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 279 - DNA, 1540 bp, Rahnella aquatilis
  gene 1..1540: note = 16S-2
  variation 267: note = n is a, c, t, g, unknown or other
  source 1..1540: mol_type = genomic DNA
attgaagagtttgatcatggctcagattgaacgctggcggcaggcctaacacatgcaagtcgagcggcatcgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctnacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcatacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 280 - DNA, 1540 bp, Rahnella aquatilis
  gene 1..1540: note = 16S-3
  variation 455: note = n is a, c, t, g, unknown or other
  source 1..1540: mol_type = genomic DNA
attgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcancatacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 281 - DNA, 1540 bp, Rahnella aquatilis
  gene 1..1540: note = 16S-4
  variation 70: note = n is a, c, t, g, unknown or other
  source 1..1540: mol_type = genomic DNA
attgaagagtttgatcatggctcagattgaacgctggcggcaggcctaacacatgcaagtcgagcggcancgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggcttacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcacacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 282 - DNA, 1540 bp, Rahnella aquatilis
  gene 1..1540: note = 16S-5
  source 1..1540: mol_type = genomic DNA
attgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcacacttaatacgtgtgttgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 283 - DNA, 1009 bp, Rahnella aquatilis
  gene 1..1009: note = 16S-6
  variation 296: note = n is a, c, t, g, unknown or other
  variation 311: note = n is a, c, t, g, unknown or other
  variation 973: note = n is a, c, t, g, unknown or other
  source 1..1009: mol_type = genomic DNA
gtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcanacttaatacgtgtgntgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtnatggtgggaactcaaaggagactgccggtgataaac

SEQ ID NO: 284 - DNA, 1519 bp, Rahnella aquatilis
  gene 1..1519: note = 16S-7
  source 1..1519: mol_type = genomic DNA
attgaagagtttgatcatggctcagattgaacgctggcggcaggcctaacacatgcaagtcgagcggcagcgggaagtagcttgctactttgccggcgagcggcggacgggtgagtaatgtcctgatggaggggataactactggaacggtagctaataccgcacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcatacttaatacgtgtggtgattgacgttactcgcagaagaagcaccggctaactccgtgccagcagccgcggtaatacggagggtgcaagcttaatcggaattactgggcgtaaagcgcacgcaggcggttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattaataccctggtagtccacgctgtaacgatgtcgacttggaggttgtgccctgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 285 - DNA, 882 bp, Rahnella aquatilis; identical to SEQ ID NO: 97
  gene 1..882: note = nifH1
  source 1..882: mol_type = genomic DNA

SEQ ID NO: 286 - DNA, 1113 bp, Rahnella aquatilis; identical to SEQ ID NO: 98
  gene 1..1113: note = nifH2
  source 1..1113: mol_type = genomic DNA

SEQ ID NO: 287 - DNA, 1374 bp, Rahnella aquatilis; identical to SEQ ID NO: 99
  gene 1..1374: note = nifD1
  source 1..1374: mol_type = genomic DNA

SEQ ID NO: 288 - DNA, 1449 bp, Rahnella aquatilis; identical to SEQ ID NO: 100
  gene 1..1449: note = nifD2
  source 1..1449: mol_type = genomic DNA

SEQ ID NO: 289 - DNA, 1386 bp, Rahnella aquatilis; identical to SEQ ID NO: 101
  gene 1..1386: note = nifK1
  source 1..1386: mol_type = genomic DNA

SEQ ID NO: 290 - DNA, 1563 bp, Rahnella aquatilis; identical to SEQ ID NO: 102
  gene 1..1563: note = nifK2
  source 1..1563: mol_type = genomic DNA

SEQ ID NO: 291 - DNA, 2838 bp, Rahnella aquatilis; identical to SEQ ID NO: 105
  gene 1..2838: note = glnE
  source 1..2838: mol_type = genomic DNA

SEQ ID NO: 292 - DNA, 449 bp, Rahnella aquatilis
  gene 1..449: note = Prm4
  source 1..449: mol_type = genomic DNA
agtctgaactcatcctgcggcagtcggtgagacgtatttttgaccaaagagtgatctacatcacggaattttgtggttgttgctgcttaaaagggcaaatctacccttagaatcaactgttatatcagggggattcagagagatattaggaatttgcacaagcgcacaatttaaccacatcatgataacgccatgtaaaacaaagataaaaaaacaaaatgcagtgacttacatcgcaagcaaggcattttcttatccaattgctcaaagtttggcctttcatatcgcaacgaaaatgcgtaatatacgcgcccttgcggacatcagtatggtcattcctagttcatgcgcatcggacaccaccagcttacaaattgcctgattgcggccccgatggccggtatcactgaccgaccatttcgtgccttatgtcatgcgatgggggctgg

SEQ ID NO: 293 - DNA, 500 bp, Rahnella aquatilis
  gene 1..500: note = Prm1.2
  source 1..500: mol_type = genomic DNA
tgaacatcactgatgcacaagctacctatgtcgaagaattaactaaaaaactgcaagatgcaggcattcgcgttaaagccgacttgagaaatgagaagattggctttaaaattcgcgaacacacgctacgccgtgttccttatatgttagtttgtggcgataaagaggtcgaagcaggcaaagttgctgttcgtacccgccgcggcaaagacttaggaagcatggatgttagcgaagtcgttgacaaactgctggcggaaatccgcagcagaagtcttcatcaactggaggaataaagtattaaaggcggaaaacgagttcaaccggcgcgtcctaatcgcattaacaaagagattcgcgcgcaagaagttcgcctcacaggcgtcgatggcgagcagattggtattgtcagtctgaatgaagctcttgaaaaagctgaggaagcgggcgtcgatttagtagaaatcagtccgaatgccgagccgccagtttgtcgaatc

SEQ ID NO: 294 - DNA, 170 bp, Rahnella aquatilis
  gene 1..170: note = Prm3.1
  source 1..170: mol_type = genomic DNA
tacagtagcgcctctcaaaaatagataaacggctcatgtacgtgggccgtttattttttctacccataatcgggaaccggtgttataatgccgcgccctcatattgtggggatttcttaatgacctatcctgggtcctaaagttgtagttgacattagcggagcactaac

SEQ ID NO: 295 - DNA, 142 bp, Rahnella aquatilis
  gene 1..142: note = Prm6.1
  source 1..142: mol_type = genomic DNA
aattttttttcacaaagcgtagcgttattgaatcgcacattttaaactgttggccgctgtggaagcgaatattggtgaaaggtgcggttttaaggcctttttctttgactctctgtcgttacaaagttaatatgcgcgccct

SEQ ID NO: 296 - DNA, 293 bp, Rahnella aquatilis
  gene 1..293: note = Prm7.1
  source 1..293: mol_type = genomic DNA
ttaaaaacgtgaccacgagcattaataaacgccacgaaatgtggcgtttatttattcaaaaagtatcttctttcataaaaagtgctaaatgcagtagcagcaaaattgggataagtcccatggaatacggctgttttcgctgcaatttttaactttttcgtaaaaaaagatgtttctttgagcgaacgatcaaaatatagcgttaaccggcaaaaaattattctcattagaaaatagtttgtgtaatacttgtaacgctacatggagattaacttaatctagagggttttata

SEQ ID NO: 297 - DNA, 1188 bp, synthetic construct; identical to SEQ ID NO: 212
  misc_feature 1..1188: note = Synthetic polynucleotide
  misc_feature 1..1188: note = glnE-delta-AR-2
  source 1..1188: mol_type = other DNA

SEQ ID NO: 298 - DNA, 2188 bp, synthetic construct; identical to SEQ ID NO: 213
  misc_feature 1..2188: note = Synthetic polynucleotide
  misc_feature 1..2188: note = glnE-delta-AR-2 with 500bp flank
  source 1..2188: mol_type = other DNA

SEQ ID NO: 299 - DNA, 524 bp, synthetic construct
  misc_feature 1..524: note = Synthetic polynucleotide
  misc_feature 1..524: note = delta-nifL::null-v1
  source 1..524: mol_type = other DNA
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggagtctgaactcatcctgcgatgggggctgggccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 300 - DNA, 1524 bp, synthetic construct
  misc_feature 1..1524: note = Synthetic polynucleotide
  misc_feature 1..1524: note = delta-nifL::null-v1 with 500bp flank
  source 1..1524: mol_type = other DNA
tgtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggagtctgaactcatcctgcgatgggggctgggccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtc

SEQ ID NO: 301 - DNA, 266 bp, synthetic construct
  misc_feature 1..266: note = Synthetic polynucleotide
  misc_feature 1..266: note = delta-nifL::null-v2
  source 1..266: mol_type = other DNA
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggttaaagcctgccggtacagcaggttatcaccggaggcttaaaatga

SEQ ID NO: 302 - DNA, 1266 bp, synthetic construct
  misc_feature 1..1266: note = Synthetic polynucleotide
  misc_feature 1..1266: note = delta-nifL::null-v2 with 500bp flank
  source 1..1266: mol_type = other DNA
tgtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggttaaagcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtc

SEQ ID NO: 303 - DNA, 943 bp, synthetic construct
  misc_feature 1..943: note = Synthetic polynucleotide
  misc_feature 1..943: note = delta-nifL::Prm4
  source 1..943: mol_type = other DNA
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggagtctgaactcatcctgcggcagtcggtgagacgtatttttgaccaaagagtgatctacatcacggaattttgtggttgttgctgcttaaaagggcaaatctacccttagaatcaactgttatatcagggggattcagagagatattaggaatttgcacaagcgcacaatttaaccacatcatgataacgccatgtaaaacaaagataaaaaaacaaaatgcagtgacttacatcgcaagcaaggcattttcttatccaattgctcaaagtttggcctttcatatcgcaacgaaaatgcgtaatatacgcgcccttgcggacatcagtatggtcattcctagttcatgcgcatcggacaccaccagcttacaaattgcctgattgcggccccgatggccggtatcactgaccgaccatttcgtgccttatgtcatgcgatgggggctgggccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 304 - DNA, 1943 bp, synthetic construct
  misc_feature 1..1943: note = Synthetic polynucleotide
  misc_feature 1..1943: note = delta-nifL::Prm4 with 500bp flank
  source 1..1943: mol_type = other DNA
tgtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggagtctgaactcatcctgcggcagtcggtgagacgtatttttgaccaaagagtgatctacatcacggaattttgtggttgttgctgcttaaaagggcaaatctacccttagaatcaactgttatatcagggggattcagagagatattaggaatttgcacaagcgcacaatttaaccacatcatgataacgccatgtaaaacaaagataaaaaaacaaaatgcagtgacttacatcgcaagcaaggcattttcttatccaattgctcaaagtttggcctttcatatcgcaacgaaaatgcgtaatatacgcgcccttgcggacatcagtatggtcattcctagttcatgcgcatcggacaccaccagcttacaaattgcctgattgcggccccgatggccggtatcactgaccgaccatttcgtgccttatgtcatgcgatgggggctgggccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtc

SEQ ID NO: 305 - DNA, 100 bp, synthetic construct
  misc_feature 1..100: note = Synthetic polynucleotide
  misc_feature 1..100: note = 100 bp upstream of junction
  source 1..100: mol_type = other DNA
tggtgtccgggcgaacgtcgccaggtggcacaaattgtcagaactacgacacgactaaccgaccgcaggagtgtgcgatgaccctgaatatgatgatgga

SEQ ID NO: 306 - DNA, 100 bp, synthetic construct
  misc_feature 1..100: note = Synthetic polynucleotide
  misc_feature 1..100: note = 100 bp upstream of junction
  source 1..100: mol_type = other DNA
cggaaaacgagttcaaacggcgcgtcccaatcgtattaatggcgagattcgcgccacggaagttcgcttaacaggtctggaaggcgagcagcttggtatt

SEQ ID NO: 307 - DNA, 100 bp, synthetic construct
  misc_feature 1..100: note = Synthetic polynucleotide
  misc_feature 1..100: note = 100 bp upstream of junction
  source 1..100: mol_type = other DNA
cgccagagagttgaaatcgaacatttccgtaataccgccattacccaggagccgttctggttgcacagcggaaaacgttaacgaaaggatatttcgcatg

SEQ ID NO: 308 - DNA, 100 bp, synthetic construct
  misc_feature 1..100: note = Synthetic polynucleotide
  misc_feature 1..100: note = 100 bp upstream of junction
  source 1..100: mol_type = other DNA
cgggcgaacgtcgccaggtggcacaaattgtcagaactacgacacgactaaccgaccgcaggagtgtgcgatgaccctgaatatgatgatggatgccagc

SEQ ID NO: 309 - DNA, 100 bp, synthetic construct
  misc_feature 1..100: note = Synthetic polynucleotide
  misc_feature 1..100: note = 100 bp upstream of junction
  source 1..100: mol_type = other DNA
tcaacctaaaaaagtttgtgtaatacttgtaacgctacatggagattaactcaatctagagggtattaataatgaatcgtactaaactggtactgggcgc

SEQ ID NO: 310 - DNA, 100 bp, synthetic construct; identical to SEQ ID NO: 308
  misc_feature 1..100: note = Synthetic polynucleotide
  misc_feature 1..100: note = 100 bp upstream of junction
  source 1..100: mol_type = other DNA

SEQ ID NO: 311 - DNA, 100 bp, synthetic construct
  misc_feature 1..100: note = Synthetic polynucleotide
  misc_feature 1..100: note = 100 bp upstream of junction
  source 1..100: mol_type = other DNA
aattttctgcccaaatggctgggattgttcattttttgtttgccttacaacgagagtgacagtacgcgcgggtagttaactcaacatctgaccggtcgat

SEQ ID NO: 312 - DNA, 100 bp, synthetic construct
  misc_feature 1..100: note = Synthetic polynucleotide
  misc_feature 1..100: note = 100 bp upstream of junction
  source 1..100: mol_type = other DNA
gtaaccaataaaggccaccacgccagaccacacgatagtgatggcaacactttccagctgcaccagcacctgatggcccatggtcacaccttcagcgaaa

SEQ ID NO: 313 - DNA, 100 bp, synthetic construct
  misc_feature 1..100: note = Synthetic polynucleotide
  misc_feature 1..100: note = 100 bp upstream of junction
  source 1..100: mol_type = other DNA
tggtattgtcagtctgaatgaagctcttgaaaaagctgaggaagcgggcgtcgatttagtagaaatcagtccgaatgccgagccgccagtttgtcgaatc

SEQ ID NO: 314 - DNA, 100 bp, synthetic construct
  misc_feature 1..100: note = Synthetic polynucleotide
  misc_feature 1..100: note = 100 bp upstream of junction
  source 1..100: mol_type = other DNA
accgatccgcaggcgcgcatttgttatgccaatccggcattctgccgccagacgggttttgcacttgagacacttttgggcgagaaccaccgtctgctgg

SEQ ID NO: 315 - DNA, 100 bp, synthetic construct
  misc_feature 1..100: note = Synthetic polynucleotide
  misc_feature 1..100: note = 100 bp upstream of junction
  source 1..100: mol_type = other DNA
cgggaaccggtgttataatgccgcgccctcatattgtggggatttcttaatgacctatcctgggtcctaaagttgtagttgacattagcggagcactaac

SEQ ID NO: 316 - DNA, 100 bp, synthetic construct; identical to SEQ ID NO: 314
  misc_feature 1..100: note = Synthetic polynucleotide
  misc_feature 1..100: note = 100 bp upstream of junction
  source 1..100: mol_type = other DNA

SEQ ID NO: 317 - DNA, 100 bp, synthetic construct; identical to SEQ ID NO: 309
  misc_feature 1..100: note = Synthetic polynucleotide
  misc_feature 1..100: note = 100 bp upstream of junction
  source 1..100: mol_type = other DNA

SEQ ID NO: 318 - DNA, 100 bp, synthetic construct
  misc_feature 1..100: note = Synthetic polynucleotide
  misc_feature 1..100: note = 100 bp upstream of junction
  source 1..100: mol_type = other DNA
gggcgacaaacggcctggtggcacaaattgtcagaactacgacacgactaactgaccgcaggagtgtgcgatgaccctgaatatgatgatggatgccggc

SEQ ID NO: 319 - DNA, 100 bp, synthetic construct; identical to SEQ ID NO: 318
  misc_feature 1..100: note = Synthetic polynucleotide
  misc_feature 1..100: note = 100 bp upstream of junction
  source 1..100: mol_type = other DNA

SEQ ID NO: 320 - DNA, 100 bp, synthetic construct
  misc_feature 1..100: note = Synthetic polynucleotide
  misc_feature 1..100: note = 100 bp upstream of junction
  source 1..100: mol_type = other DNA
taagaattatctggatgaatgtgccattaaatgcgcagcataatggtgcgttgtgcgggaaaactgcttttttttgaaagggttggtcagtagcggaaac

SEQ ID NO: 321 - DNA, 100 bp, synthetic construct
  misc_feature 1..100: note = Synthetic polynucleotide
  misc_feature 1..100: note = 100 bp upstream of junction
  source 1..100: mol_type = other DNA
cgccagagagtcgaaatcgaacatttccgtaataccgcgattacccaggagccgttctggttgcacagcggaaaacgttaacgaaaggatatttcgcatg

SEQ ID NO: 322 - DNA, 100 bp, synthetic construct; identical to SEQ ID NO: 321
  misc_feature 1..100: note = Synthetic polynucleotide
  misc_feature 1..100: note = 100 bp upstream of junction
  source 1..100: mol_type = other DNA

SEQ ID NO: 323 - DNA, 100 bp, synthetic construct
  misc_feature 1..100: note = Synthetic polynucleotide
  misc_feature 1..100: note = 100 bp upstream of junction
  source 1..100: mol_type = other DNA
gatgatggatgctttctggttaaacgggcaacctcgttaactgactgactagcctgggcaaactgcccgggcttttttttgcaaggaatctgatttcatg

SEQ ID NO: 324 - DNA, 100 bp, synthetic construct; identical to SEQ ID NO: 314
  misc_feature 1..100: note = Synthetic polynucleotide
  misc_feature 1..100: note = 100 bp upstream of junction
  source 1..100: mol_type = other DNA

SEQ ID NO: 325 - DNA, 100 bp, synthetic construct
  misc_feature 1..100: note = Synthetic polynucleotide
  misc_feature 1..100: note = 100 bp upstream of junction
  source 1..100: mol_type = other DNA
catcggacaccaccagcttacaaattgcctgattgcggccccgatggccggtatcactgaccgaccatttcgtgccttatgtcatgcgatgggggctggg

SEQ ID NO: 326 - DNA, 100 bp, synthetic construct
  misc_feature 1..100: note = Synthetic polynucleotide
  misc_feature 1..100: note = 100 bp upstream of junction
  source 1..100: mol_type = other DNA
tcttcaacaactggaggaataaggtattaaaggcggaaaacgagttcaaacggcacgtccgaatcgtatcaatggcgagattcgcgccctggaagttcgc

SEQ ID NO: 327 - DNA, 100 bp, synthetic construct
  misc_feature 1..100: note = Synthetic polynucleotide
  misc_feature 1..100: note = 100 bp upstream of junction
  source 1..100: mol_type = other DNA
tccgggttcggcttaccccgccgcgttttgcgcacggtgtcggacaatttgtcataactgcgacacaggagtttgcgatgaccctgaatatgatgctcga

SEQ ID NO: 328 - DNA, 100 bp, synthetic construct
  misc_feature 1..100: note = Synthetic polynucleotide
  misc_feature 1..100: note = 100 bp upstream of junction
  source 1..100: mol_type = other DNA
atcgcagcgtctttgaatatttccgtcgccaggcgctggctgccgagccgttctggctgcatagtggaaaacgataatttcaggccagggagcccttatg

SEQ ID NO: 329 - DNA, 100 bp, synthetic construct; identical to SEQ ID NO: 327
  misc_feature 1..100: note = Synthetic polynucleotide
  misc_feature 1..100: note = 100 bp upstream of junction
  source 1..100: mol_type = other DNA

SEQ ID NO: 330 - DNA, 100 bp, synthetic construct
  misc_feature 1..100: note = Synthetic polynucleotide
  misc_feature 1..100: note = 100 bp upstream of junction
  source 1..100: mol_type = other DNA
tcactttttagcaaagttgcactggacaaaaggtaccacaattggtgtactgatactcgacacagcattagtgtcgatttttcatataaaggtaattttg

SEQ ID NO: 331 - DNA, 100 bp, synthetic construct; identical to SEQ ID NO: 327
  misc_feature 1..100: note = Synthetic polynucleotide
  misc_feature 1..100: note = 100 bp upstream of junction
  source 1..100: mol_type = other DNA

SEQ ID NO: 332 - DNA, 100 bp, synthetic construct
  misc_feature 1..100: note = Synthetic polynucleotide
  misc_feature 1..100: note = 100 bp upstream of junction
  source 1..100: mol_type = other DNA
gttctcctttgcaatagcagggaagaggcgccagaaccgccagcgttgaagcagtttgaacgcgttcagtgtataatccgaaacttaatttcggtttgga

SEQ ID NO: 333 - DNA, 100 bp, synthetic construct; identical to SEQ ID NO: 327
  misc_feature 1..100: note = Synthetic polynucleotide
  misc_feature 1..100: note = 100 bp upstream of junction
  source 1..100: mol_type = other DNA

SEQ ID NO: 334 - DNA, 100 bp, synthetic construct
  misc_feature 1..100: note = Synthetic polynucleotide
  misc_feature 1..100: note = 100 bp upstream of junction
  source 1..100: mol_type = other DNA
gatatgcctgaagtattcaattacttaggcatttacttaacgcaggcaggcaattttgatgctgcctatgaagcgtttgattctgtacttgagcttgatc

SEQ ID NO: 335 - DNA, 100 bp, synthetic construct; identical to SEQ ID NO: 313
  misc_feature 1..100: note = Synthetic polynucleotide
  misc_feature 1..100: note = 100 bp upstream of junction
  source 1..100: mol_type = other DNA

SEQ ID NO: 336 - DNA, 100 bp, synthetic construct
  misc_feature 1..100: note = Synthetic polynucleotide
  misc_feature 1..100: note = 100 bp upstream of junction
  source 1..100: mol_type = other DNA
tgcaaattgcacggttattccgggtgagtatatgtgtgatttgggttccggcattgcgcaataaaggggagaaagacatgagcatcacggcgttatcagc

SEQ ID NO: 337 - DNA, 100 bp, synthetic construct
  misc_feature 1..100: note = Synthetic polynucleotide
  misc_feature 1..100: note = 100 bp upstream of junction
  source 1..100: mol_type = other DNA
tcagggctgcggatgtcgggcgtttcacaacacaaaatgttgtaaatgcgacacagccgggcctgaaaccaggagcgtgtgatgacctttaatatgatgc

SEQ ID NO: 338 - DNA, 100 bp, synthetic construct
  misc_feature 1..100: note = Synthetic polynucleotide
  misc_feature 1..100: note = 100 bp upstream of junction
  source 1..100: mol_type = other DNA
cggaaaacgagttcaaacggcacgtccgaatcgtatcaatggcgagattcgcgcccaggaagttcgcttaactggtctggaaggtgagcagctgggtatt

SEQ ID NO: 339 - DNA, 100 bp, synthetic construct
  misc_feature 1..100: note = Synthetic polynucleotide
  misc_feature 1..100: note = 100 bp downstream of junction
  source 1..100: mol_type = other DNA
ttcttggttctctggagcgctttatcggcatcctgactgaagaatttgcaggcttcttcccaacctggcttgcacccgtgcaggtagttgtgatgaacat

SEQ ID NO: 340 - DNA, 100 bp, synthetic construct
  misc_feature 1..100: note = Synthetic polynucleotide
  misc_feature 1..100: note = 100 bp downstream of junction
  source 1..100: mol_type = other DNA
gcgatagaactcacttcacgccccgaagggggaagctgcctgaccctacgattcccgctatttcattcactgaccggaggttcaaaatgacccagcgaac

SEQ ID NO: 341 - DNA, 100 bp, synthetic construct
  misc_feature 1..100: note = Synthetic polynucleotide
  misc_feature 1..100: note = 100 bp downstream of junction
  source 1..100: mol_type = other DNA
tccctgtgcgccgcgtcgccgatggtggccagccaactggcgcgctacccgatcctgctcgatgaactgctcgacccgaacacgctctatcaaccgacgg

SEQ ID NO: 342 - DNA, 100 bp, synthetic construct
  misc_feature 1..100: note = Synthetic polynucleotide
  misc_feature 1..100: note = 100 bp downstream of junction
  source 1..100: mol_type = other DNA
cgttctgtaataataaccggacaattcggactgattaaaaaagcgccctcgcggcgctttttttatattctcgactccatttaaaataaaaaatccaatc

SEQ ID NO: 343 - DNA, 100 bp, synthetic construct
  misc_feature 1..100: note = Synthetic polynucleotide
  misc_feature 1..100: note = 100 bp downstream of junction
  source 1..100: mol_type = other DNA
aactcacttcacgccccgaagggggaagctgcctgaccctacgattcccgctatttcattcactgaccggaggttcaaaatgacccagcgaaccgagtcg

SEQ ID NO: 344 - DNA, 100 bp, synthetic construct
  misc_feature 1..100: note = Synthetic polynucleotide
  misc_feature 1..100: note = 100 bp downstream of junction
  source 1..100: mol_type = other DNA
cgcgtcaggttgaacgtaaaaaagtcggtctgcgcaaagcacgtcgtcgtccgcagttctccaaacgttaattggtttctgcttcggcagaacgattggc

SEQ ID NO: 345 - DNA, 100 bp, synthetic construct; identical to SEQ ID NO: 343
  misc_feature 1..100: note = Synthetic polynucleotide
  misc_feature 1..100: note = 100 bp downstream of junction
  source 1..100: mol_type = other DNA

SEQ ID NO: 346 - DNA, 100 bp, synthetic construct
  misc_feature 1..100: note = Synthetic polynucleotide
  misc_feature 1..100: note = 100 bp downstream of junction
  source 1..100: mol_type = other DNA
ccgatccccatcactgtgtgtcttgtattacagtgccgcttcgtcggcttcgccggtacgaatacgaatgacgcgttgcagctcagcaacgaaaattttg

SEQ ID NO: 347 - DNA, 100 bp, synthetic construct
  misc_feature 1..100: note = Synthetic polynucleotide
  misc_feature 1..100: note = 100 bp downstream of junction
  source 1..100: mol_type = other DNA
ccgtctctgaagctctcggtgaacattgttgcgaggcaggatgcgagctggttgtgttttgacattaccgataatgtgccgcgtgaacgggtgcgttatg

SEQ ID NO: 348 - DNA, 100 bp, synthetic construct
  misc_feature 1..100: note = Synthetic polynucleotide
  misc_feature 1..100: note = 100 bp downstream of junction
  source 1..100: mol_type = other DNA
tgaacatcactgatgcacaagctacctatgtcgaagaattaactaaaaaactgcaagatgcaggcattcgcgttaaagccgacttgagaaatgagaagat

SEQ ID NO: 349 - DNA, 100 bp, synthetic construct; identical to SEQ ID NO: 347
  misc_feature 1..100: note = Synthetic polynucleotide
  misc_feature 1..100: note = 100 bp downstream of junction
  source 1..100: mol_type = other DNA

SEQ ID NO: 350 - DNA, 100 bp, synthetic construct
  misc_feature 1..100: note = Synthetic polynucleotide
  misc_feature 1..100: note = 100 bp downstream of junction
  source 1..100: mol_type = other DNA
tacagtagcgcctctcaaaaatagataaacggctcatgtacgtgggccgtttattttttctacccataatcgggaaccggtgttataatgccgcgccctc

SEQ ID NO: 351 - DNA, 100 bp, synthetic construct
  misc_feature 1..100: note = Synthetic polynucleotide
  misc_feature 1..100: note = 100 bp downstream of junction
  source 1..100: mol_type = other DNA
aactcacttcacaccccgaagggggaagttgcctgaccctacgattcccgctatttcattcactgaccggaggttcaaaatgacccagcgaaccgagtcg

SEQ ID NO: 352 - DNA, 100 bp, synthetic construct
  misc_feature 1..100: note = Synthetic polynucleotide
  misc_feature 1..100: note = 100 bp downstream of junction
  source 1..100: mol_type = other DNA
cgtcctgtaataataaccggacaattcggactgattaaaaaagcgcccttgtggcgctttttttatattcccgcctccatttaaaataaaaaatccaatc

SEQ ID NO: 353 - DNA, 100 bp, synthetic construct
  misc_feature 1..100: note = Synthetic polynucleotide
  misc_feature 1..100: note = 100 bp downstream of junction
  source 1..100: mol_type = other DNA
ggacatcatcgcgacaaacaatattaataccggcaaccacaccggcaatttacgagactgcgcaggcatcctttctcccgtcaatttctgtcaaataaag

SEQ ID NO: 354 - DNA, 100 bp, synthetic construct; identical to SEQ ID NO: 351
  misc_feature 1..100: note = Synthetic polynucleotide
  misc_feature 1..100: note = 100 bp downstream of junction
  source 1..100: mol_type = other DNA

SEQ ID NO: 355 - DNA, 100 bp, synthetic construct
  misc_feature 1..100: note = Synthetic polynucleotide
  misc_feature 1..100: note = 100 bp downstream of junction
  source 1..100: mol_type = other DNA
tttaacgatctgattggcgatgatgaaacggattcgccggaagatgcgctttctgagagctggcgcgaattgtggcaggatgcgttgcaggaggaggatt

SEQ ID NO: 356 - DNA, 100 bp, synthetic construct
  misc_feature 1..100: note = Synthetic polynucleotide
  misc_feature 1..100: note = 100 bp downstream of junction
  source 1..100: mol_type = other DNA
gcactgaaacacctcatttccctgtgtgccgcgtcgccgatggttgccagtcagctggcgcgctacccgatcctgcttgatgaattgctcgacccgaata

SEQ ID NO: 357 - DNA, 100 bp, synthetic construct
  misc_feature 1..100: note = Synthetic polynucleotide
  misc_feature 1..100: note = 100 bp downstream of junction
  source 1..100: mol_type = other DNA
gcgctcaaacagttaatccgtctgtgtgccgcctcgccgatggtcgcgacacaacttgcacgtcatcctttattgctcgatgaactgctcgacccgcgca

SEQ ID NO: 358 - DNA, 100 bp, synthetic construct
  misc_feature 1..100: note = Synthetic polynucleotide
  misc_feature 1..100: note = 100 bp downstream of junction
  source 1..100: mol_type = other DNA
agtctgaactcatcctgcggcagtcggtgagacgtatttttgaccaaagagtgatctacatcacggaattttgtggttgttgctgcttaaaagggcaaat

SEQ ID NO: 359 - DNA, 100 bp, synthetic construct; identical to SEQ ID NO: 347
  misc_feature 1..100: note = Synthetic polynucleotide
  misc_feature 1..100: note = 100 bp downstream of junction
  source 1..100: mol_type = other DNA

SEQ ID NO: 360 - DNA, 100 bp, synthetic construct
  misc_feature 1..100: note = Synthetic polynucleotide
  misc_feature 1..100: note = 100 bp downstream of junction
  source 1..100: mol_type = other DNA
gccattgagctggcttcccgaccgcagggcggcacctgcctgaccctgcgtttcccgctgtttaacaccctgaccggaggtgaagcatgatccctgaatc

SEQ ID NO: 361 - DNA, 100 bp, synthetic construct
  misc_feature 1..100: note = Synthetic polynucleotide
  misc_feature 1..100: note = 100 bp downstream of junction
  source 1..100: mol_type = other DNA
agcgtcaggtaccggtcatgattcaccgtgcgattctcggttccctggagcgcttcattggcatcctgaccgaagagttcgctggcttcttcccaacctg

SEQ ID NO: 362 - DNA, 100 bp, synthetic construct
  misc_feature 1..100: note = Synthetic polynucleotide
  misc_feature 1..100: note = 100 bp downstream of junction
  source 1..100: mol_type = other DNA
gcgctgaagcacctgatcacgctctgcgcggcgtcgccgatggtcgccagccagctggcgcgccacccgctgctgctggatgagctgctggatcccaaca

SEQ ID NO: 363 - DNA, 100 bp, synthetic construct
  misc_feature 1..100: note = Synthetic polynucleotide
  misc_feature 1..100: note = 100 bp downstream of junction
  source 1..100: mol_type = other DNA
gcccgctgaccgaccagaacttccaccttggactcggctatacccttggcgtgacggcgcgcgataactgggactacatccccattccggtgatcttacc

SEQ ID NO: 364 - DNA, 100 bp, synthetic construct; identical to SEQ ID NO: 360
  misc_feature 1..100: note = Synthetic polynucleotide
  misc_feature 1..100: note = 100 bp downstream of junction
  source 1..100: mol_type = other DNA

SEQ ID NO: 365 - DNA, 100 bp, synthetic construct
  misc_feature 1..100: note = Synthetic polynucleotide
  misc_feature 1..100: note = 100 bp downstream of junction
  source 1..100: mol_type = other DNA
gctaaagttctcggctaatcgctgataacatttgacgcaatgcgcaataaaagggcatcatttgatgccctttttgcacgctttcataccagaacctggc

SEQ ID NO: 366 - DNA, 100 bp, synthetic construct; identical to SEQ ID NO: 360
  misc_feature 1..100: note = Synthetic polynucleotide
  misc_feature 1..100: note = 100 bp downstream of junction
  source 1..100: mol_type = other DNA

SEQ ID NO: 367 - DNA, 100 bp, synthetic construct
  misc_feature 1..100: note = Synthetic polynucleotide
  misc_feature 1..100: note = 100 bp downstream of junction
  source 1..100: mol_type = other DNA
cgccgtcctcgcagtaccattgcaaccgactttacagcaagaagtgattctggcacgcatggaacaaattcttgccagtcgggctttatccgatgacgaa

SEQ ID NO: 368 - DNA, 100 bp, synthetic construct; identical to SEQ ID NO: 360
  misc_feature 1..100: note = Synthetic polynucleotide
  misc_feature 1..100: note = 100 bp downstream of junction
  source 1..100: mol_type = other DNA

SEQ ID NO: 369 - DNA, 100 bp, synthetic construct
  misc_feature 1..100: note = Synthetic polynucleotide
  misc_feature 1..100: note = 100 bp downstream of junction
  source 1..100: mol_type = other DNA
tctttagatctctcggtccgccctgatggcggcaccttgctgacgttacgcctgccggtacagcaggttatcaccggaggcttaaaatgacccagttacc

SEQ ID NO: 370 - DNA, 100 bp, synthetic construct
  misc_feature 1..100: note = Synthetic polynucleotide
  misc_feature 1..100: note = 100 bp downstream of junction
  source 1..100: mol_type = other DNA
tgaatatcactgactcacaagctacctatgtcgaagaattaactaaaaaactgcaagatgcaggcattcgcgttaaagccgacttgagaaatgagaagat

SEQ ID NO: 371 - DNA, 100 bp, synthetic construct
  misc_feature 1..100: note = Synthetic polynucleotide
  misc_feature 1..100: note = 100 bp downstream of junction
  source 1..100: mol_type = other DNA
ctggggtcactggagcgctttatcggcatcctgaccgaagaatttgccggtttcttcccgacctggctggcccctgttcaggttgtggtgatgaatatca

SEQ ID NO: 372 - DNA, 100 bp, synthetic construct
  misc_feature 1..100: note = Synthetic polynucleotide
  misc_feature 1..100: note = 100 bp downstream of junction
  source 1..100: mol_type = other DNA
gcaatagaactaactacccgccctgaaggcggtacctgcctgaccctgcgattcccgttatttcattcactgaccggaggcccacgatgacccagcgacc

SEQ ID NO: 373 - DNA, 200 bp, synthetic construct
  misc_feature 1..200: note = Synthetic polynucleotide
  misc_feature 1..200: note = disrupted nifL gene / PinfC
  source 1..200: mol_type = other DNA
tggtgtccgggcgaacgtcgccaggtggcacaaattgtcagaactacgacacgactaaccgaccgcaggagtgtgcgatgaccctgaatatgatgatggattcttggttctctggagcgctttatcggcatcctgactgaagaatttgcaggcttcttcccaacctggcttgcacccgtgcaggtagttgtgatgaacat

SEQ ID NO: 374 - DNA, 200 bp, synthetic construct
  misc_feature 1..200: note = Synthetic polynucleotide
  misc_feature 1..200: note = PinfC / disrupted nifL gene
  source 1..200: mol_type = other DNA
cggaaaacgagttcaaacggcgcgtcccaatcgtattaatggcgagattcgcgccacggaagttcgcttaacaggtctggaaggcgagcagcttggtattgcgatagaactcacttcacgccccgaagggggaagctgcctgaccctacgattcccgctatttcattcactgaccggaggttcaaaatgacccagcgaac

SEQ ID NO: 375 - DNA, 200 bp, synthetic construct
  misc_feature 1..200: note = Synthetic polynucleotide
  misc_feature 1..200: note = 5' UTR and ATG / truncated glnE gene
  source 1..200: mol_type = other DNA
cgccagagagttgaaatcgaacatttccgtaataccgccattacccaggagccgttctggttgcacagcggaaaacgttaacgaaaggatatttcgcatgtccctgtgcgccgcgtcgccgatggtggccagccaactggcgcgctacccgatcctgctcgatgaactgctcgacccgaacacgctctatcaaccgacgg

SEQ ID NO: 376 - DNA, 200 bp, synthetic construct
  misc_feature 1..200: note = Synthetic polynucleotide
  misc_feature 1..200: note = disrupted nifL gene / Prm1
  source 1..200: mol_type = other DNA
cgggcgaacgtcgccaggtggcacaaattgtcagaactacgacacgactaaccgaccgcaggagtgtgcgatgaccctgaatatgatgatggatgccagccgttctgtaataataaccggacaattcggactgattaaaaaagcgccctcgcggcgctttttttatattctcgactccatttaaaataaaaaatccaatc

SEQ ID NO: 377 - DNA, 200 bp, synthetic construct
  misc_feature 1..200: note = Synthetic polynucleotide
  misc_feature 1..200: note = Prm1 / disrupted nifL gene
  source 1..200: mol_type = other DNA
tcaacctaaaaaagtttgtgtaatacttgtaacgctacatggagattaactcaatctagagggtattaataatgaatcgtactaaactggtactgggcgcaactcacttcacgccccgaagggggaagctgcctgaccctacgattcccgctatttcattcactgaccggaggttcaaaatgacccagcgaaccgagtcg

SEQ ID NO: 378 - DNA, 200 bp, synthetic construct
  misc_feature 1..200: note = Synthetic polynucleotide
  misc_feature 1..200: note = disrupted nifL gene / Prm7
  source 1..200: mol_type = other DNA
cgggcgaacgtcgccaggtggcacaaattgtcagaactacgacacgactaaccgaccgcaggagtgtgcgatgaccctgaatatgatgatggatgccagccgcgtcaggttgaacgtaaaaaagtcggtctgcgcaaagcacgtcgtcgtccgcagttctccaaacgttaattggtttctgcttcggcagaacgattggc

SEQ ID NO: 379 - DNA, 200 bp, synthetic construct
  misc_feature 1..200: note = Synthetic polynucleotide
  misc_feature 1..200: note = Prm4 / disrupted nifL gene
  source 1..200: mol_type = other DNA
aattttctgcccaaatggctgggattgttcattttttgtttgccttacaacgagagtgacagtacgcgcgggtagttaactcaacatctgaccggtcgataactcacttcacgccccgaagggggaagctgcctgaccctacgattcccgctatttcattcactgaccggaggttcaaaatgacccagcgaaccgagtcg

SEQ ID NO: 380 - DNA, 200 bp, synthetic construct
  misc_feature 1..200: note = Synthetic polynucleotide
  misc_feature 1..200: note = 5' UTR up to ATG-4bp of amtB gene / disrupted amtB gene
  source 1..200: mol_type = other DNA
gtaaccaataaaggccaccacgccagaccacacgatagtgatggcaacactttccagctgcaccagcacctgatggcccatggtcacaccttcagcgaaaccgatccccatcactgtgtgtcttgtattacagtgccgcttcgtcggcttcgccggtacgaatacgaatgacgcgttgcagctcagcaacgaaaattttg

SEQ ID NO: 381 - DNA, 200 bp, synthetic construct
  misc_feature 1..200: note = Synthetic polynucleotide
  misc_feature 1..200: note = Prm1.2 / disrupted nifL gene
  source 1..200: mol_type = other DNA
tggtattgtcagtctgaatgaagctcttgaaaaagctgaggaagcgggcgtcgatttagtagaaatcagtccgaatgccgagccgccagtttgtcgaatcccgtctctgaagctctcggtgaacattgttgcgaggcaggatgcgagctggttgtgttttgacattaccgataatgtgccgcgtgaacgggtgcgttatg

SEQ ID NO: 382 - DNA, 200 bp, synthetic construct
  misc_feature 1..200: note = Synthetic polynucleotide
  misc_feature 1..200: note = disrupted nifL gene / Prm1.2
  source 1..200: mol_type = other DNA
accgatccgcaggcgcgcatttgttatgccaatccggcattctgccgccagacgggttttgcacttgagacacttttgggcgagaaccaccgtctgctggtgaacatcactgatgcacaagctacctatgtcgaagaattaactaaaaaactgcaagatgcaggcattcgcgttaaagccgacttgagaaatgagaagat

SEQ ID NO: 383 - DNA, 200 bp, synthetic construct
  misc_feature 1..200: note = Synthetic polynucleotide
  misc_feature 1..200: note = Prm3.1 / disrupted nifL gene
  source 1..200: mol_type = other DNA
cgggaaccggtgttataatgccgcgccctcatattgtggggatttcttaatgacctatcctgggtcctaaagttgtagttgacattagcggagcactaacccgtctctgaagctctcggtgaacattgttgcgaggcaggatgcgagctggttgtgttttgacattaccgataatgtgccgcgtgaacgggtgcgttatg

SEQ ID NO: 384 - DNA, 200 bp, synthetic construct
  misc_feature 1..200: note = Synthetic polynucleotide
  misc_feature 1..200: note = disrupted nifL gene / Prm3.1
  source 1..200: mol_type = other DNA
accgatccgcaggcgcgcatttgttatgccaatccggcattctgccgccagacgggttttgcacttgagacacttttgggcgagaaccaccgtctgctggtacagtagcgcctctcaaaaatagataaacggctcatgtacgtgggccgtttattttttctacccataatcgggaaccggtgttataatgccgcgccctc

SEQ ID NO: 385 - DNA, 200 bp, synthetic construct
  misc_feature 1..200: note = Synthetic polynucleotide
  misc_feature 1..200: note = Prm1 / disrupted nifL gene
  source 1..200: mol_type = other DNA
tcaacctaaaaaagtttgtgtaatacttgtaacgctacatggagattaactcaatctagagggtattaataatgaatcgtactaaactggtactgggcgcaactcacttcacaccccgaagggggaagttgcctgaccctacgattcccgctatttcattcactgaccggaggttcaaaatgacccagcgaaccgagtcg

SEQ ID NO: 386 - DNA, 200 bp, synthetic construct
  misc_feature 1..200: note = Synthetic polynucleotide
  misc_feature 1..200: note = disrupted nifL gene / Prm1
  source 1..200: mol_type = other DNA
gggcgacaaacggcctggtggcacaaattgtcagaactacgacacgactaactgaccgcaggagtgtgcgatgaccctgaatatgatgatggatgccggccgtcctgtaataataaccggacaattcggactgattaaaaaagcgcccttgtggcgctttttttatattcccgcctccatttaaaataaaaaatccaatc

SEQ ID NO: 387 - DNA, 200 bp, synthetic construct
  misc_feature 1..200: note = Synthetic polynucleotide
  misc_feature 1..200: note = disrupted nifL gene / Prm5
  source 1..200: mol_type = other DNA
gggcgacaaacggcctggtggcacaaattgtcagaactacgacacgactaactgaccgcaggagtgtgcgatgaccctgaatatgatgatggatgccggcggacatcatcgcgacaaacaatattaataccggcaaccacaccggcaatttacgagactgcgcaggcatcctttctcccgtcaatttctgtcaaataaag

SEQ ID NO: 388 - DNA, 200 bp, synthetic construct
  misc_feature 1..200: note = Synthetic polynucleotide
  misc_feature 1..200: note = Prm5 / disrupted nifL gene
  source 1..200: mol_type = other DNA
taagaattatctggatgaatgtgccattaaatgcgcagcataatggtgcgttgtgcgggaaaactgcttttttttgaaagggttggtcagtagcggaaacaactcacttcacaccccgaagggggaagttgcctgaccctacgattcccgctatttcattcactgaccggaggttcaaaatgacccagcgaaccgagtcg

SEQ ID NO: 389 - DNA, 200 bp, synthetic construct
  misc_feature 1..200: note = Synthetic polynucleotide
  misc_feature 1..200: note = 5' UTR and ATG / truncated glnE gene
  source 1..200: mol_type = other DNA
cgccagagagtcgaaatcgaacatttccgtaataccgcgattacccaggagccgttctggttgcacagcggaaaacgttaacgaaaggatatttcgcatgtttaacgatctgattggcgatgatgaaacggattcgccggaagatgcgctttctgagagctggcgcgaattgtggcaggatgcgttgcaggaggaggatt

SEQ ID NO: 390 - DNA, 200 bp, synthetic construct
  misc_feature 1..200: note = Synthetic polynucleotide
  misc_feature 1..200: note = 5' UTR and ATG / truncated glnE gene
  source 1..200: mol_type = other DNA
cgccagagagtcgaaatcgaacatttccgtaataccgcgattacccaggagccgttctggttgcacagcggaaaacgttaacgaaaggatatttcgcatggcactgaaacacctcatttccctgtgtgccgcgtcgccgatggttgccagtcagctggcgcgctacccgatcctgcttgatgaattgctcgacccgaata

SEQ ID NO: 391 - DNA, 200 bp, synthetic construct
  misc_feature 1..200: note = Synthetic polynucleotide
  misc_feature 1..200: note = 5' UTR and ATG / truncated glnE gene
  source 1..200: mol_type = other DNA
gatgatggatgctttctggttaaacgggcaacctcgttaactgactgactagcctgggcaaactgcccgggcttttttttgcaaggaatctgatttcatggcgctcaaacagttaatccgtctgtgtgccgcctcgccgatggtcgcgacacaacttgcacgtcatcctttattgctcgatgaactgctcgacccgcgca

SEQ ID NO: 392 - DNA, 200 bp, synthetic construct
  misc_feature 1..200: note = Synthetic polynucleotide
  misc_feature 1..200: note = disrupted nifL gene / Prm4
  source 1..200: mol_type = other DNA
accgatccgcaggcgcgcatttgttatgccaatccggcattctgccgccagacgggttttgcacttgagacacttttgggcgagaaccaccgtctgctggagtctgaactcatcctgcggcagtcggtgagacgtatttttgaccaaagagtgatctacatcacggaattttgtggttgttgctgcttaaaagggcaaat

SEQ ID NO: 393 - DNA, 200 bp, synthetic construct
  misc_feature 1..200: note = Synthetic polynucleotide
  misc_feature 1..200: note = Prm4 / disrupted nifL gene
  source 1..200: mol_type = other DNA
catcggacaccaccagcttacaaattgcctgattgcggccccgatggccggtatcactgaccgaccatttcgtgccttatgtcatgcgatgggggctgggccgtctctgaagctctcggtgaacattgttgcgaggcaggatgcgagctggttgtgttttgacattaccgataatgtgccgcgtgaacgggtgcgttatg

SEQ ID NO: 394 - DNA, 200 bp, synthetic construct
  misc_feature 1..200: note = Synthetic polynucleotide
  misc_feature 1..200: note = PinfC / disrupted nifL gene
  source 1..200: mol_type = other DNA
tcttcaacaactggaggaataaggtattaaaggcggaaaacgagttcaaacggcacgtccgaatcgtatcaatggcgagattcgcgccctggaagttcgcgccattgagctggcttcccgaccgcagggcggcacctgcctgaccctgcgtttcccgctgtttaacaccctgaccggaggtgaagcatgatccctgaatc

SEQ ID NO: 395 - DNA, 200 bp, synthetic construct
  misc_feature 1..200: note = Synthetic polynucleotide
  misc_feature 1..200: note = disrupted nifL gene / PinfC
  source 1..200: mol_type = other DNA
tccgggttcggcttaccccgccgcgttttgcgcacggtgtcggacaatttgtcataactgcgacacaggagtttgcgatgaccctgaatatgatgctcgaagcgtcaggtaccggtcatgattcaccgtgcgattctcggttccctggagcgcttcattggcatcctgaccgaagagttcgctggcttcttcccaacctg

SEQ ID NO: 396 - DNA, 200 bp, synthetic construct
  misc_feature 1..200: note = Synthetic polynucleotide
  misc_feature 1..200: note = 5' UTR and ATG / truncated glnE gene
  source 1..200: mol_type = other DNA
atcgcagcgtctttgaatatttccgtcgccaggcgctggctgccgagccgttctggctgcatagtggaaaacgataatttcaggccagggagcccttatggcgctgaagcacctgatcacgctctgcgcggcgtcgccgatggtcgccagccagctggcgcgccacccgctgctgctggatgagctgctggatcccaaca

SEQ ID NO: 397 - DNA, 200 bp, synthetic construct
  misc_feature 1..200: note = Synthetic polynucleotide
  misc_feature 1..200: note = disrupted nifL gene / Prm1.2
  source 1..200: mol_type = other DNA
tccgggttcggcttaccccgccgcgttttgcgcacggtgtcggacaatttgtcataactgcgacacaggagtttgcgatgaccctgaatatgatgctcgagcccgctgaccgaccagaacttccaccttggactcggctatacccttggcgtgacggcgcgcgataactgggactacatccccattccggtgatcttacc

SEQ ID NO: 398 - DNA, 200 bp, synthetic construct
  misc_feature 1..200: note = Synthetic polynucleotide
  misc_feature 1..200: note = Prm1.2 / disrupted nifL gene
  source 1..200: mol_type = other DNA
tcactttttagcaaagttgcactggacaaaaggtaccacaattggtgtactgatactcgacacagcattagtgtcgatttttcatataaaggtaattttggccattgagctggcttcccgaccgcagggcggcacctgcctgaccctgcgtttcccgctgtttaacaccctgaccggaggtgaagcatgatccctgaatc

SEQ ID NO: 399 - DNA, 200 bp, synthetic construct
  misc_feature 1..200: note = Synthetic polynucleotide
  misc_feature 1..200: note = disrupted nifL gene / Prm6.2
  source 1..200: mol_type = other DNA
tccgggttcggcttaccccgccgcgttttgcgcacggtgtcggacaatttgtcataactgcgacacaggagtttgcgatgaccctgaatatgatgctcgagctaaagttctcggctaatcgctgataacatttgacgcaatgcgcaataaaagggcatcatttgatgccctttttgcacgctttcataccagaacctggc

SEQ ID NO: 400 - DNA, 200 bp, synthetic construct
  misc_feature 1..200: note = Synthetic polynucleotide
  misc_feature 1..200: note = Prm6.2 / disrupted nifL gene
  source 1..200: mol_type = other DNA
gttctcctttgcaatagcagggaagaggcgccagaaccgccagcgttgaagcagtttgaacgcgttcagtgtataatccgaaacttaatttcggtttggagccattgagctggcttcccgaccgcagggcggcacctgcctgaccctgcgtttcccgctgtttaacaccctgaccggaggtgaagcatgatccctgaatc

SEQ ID NO: 401 - DNA, 200 bp, synthetic construct
  misc_feature 1..200: note = Synthetic polynucleotide
  misc_feature 1..200: note = disrupted nifL gene / Prm8.2
  source 1..200: mol_type = other DNA
tccgggttcggcttaccccgccgcgttttgcgcacggtgtcggacaatttgtcataactgcgacacaggagtttgcgatgaccctgaatatgatgctcgacgccgtcctcgcagtaccattgcaaccgactttacagcaagaagtgattctggcacgcatggaacaaattcttgccagtcgggctttatccgatgacgaa

SEQ ID NO: 402 - DNA, 200 bp, synthetic construct
  misc_feature 1..200: note = Synthetic polynucleotide
  misc_feature 1..200: note = Prm8.2 / disrupted nifL gene
  source 1..200: mol_type = other DNA
gatatgcctgaagtattcaattacttaggcatttacttaacgcaggcaggcaattttgatgctgcctatgaagcgtttgattctgtacttgagcttgatcgccattgagctggcttcccgaccgcagggcggcacctgcctgaccctgcgtttcccgctgtttaacaccctgaccggaggtgaagcatgatccctgaatc

SEQ ID NO: 403 - DNA, 200 bp, synthetic construct
  misc_feature 1..200: note = Synthetic polynucleotide
  misc_feature 1..200: note = PinfC / disrupted nifL gene
  source 1..200: mol_type = other DNA
tggtattgtcagtctgaatgaagctcttgaaaaagctgaggaagcgggcgtcgatttagtagaaatcagtccgaatgccgagccgccagtttgtcgaatctctttagatctctcggtccgccctgatggcggcaccttgctgacgttacgcctgccggtacagcaggttatcaccggaggcttaaaatgacccagttacc

SEQ ID NO: 404 - DNA, 200 bp, synthetic construct
  misc_feature 1..200: note = Synthetic polynucleotide
  misc_feature 1..200: note = disrupted nifL gene / PinfC
  source 1..200: mol_type = other DNA
tgcaaattgcacggttattccgggtgagtatatgtgtgatttgggttccggcattgcgcaataaaggggagaaagacatgagcatcacggcgttatcagctgaatatcactgactcacaagctacctatgtcgaagaattaactaaaaaactgcaagatgcaggcattcgcgttaaagccgacttgagaaatgagaagat

SEQ ID NO: 405 - DNA, 200 bp, synthetic construct
  misc_feature 1..200: note = Synthetic polynucleotide
  misc_feature 1..200: note = disrupted nifL gene / PinfC
  source 1..200: mol_type = other DNA
tcagggctgcggatgtcgggcgtttcacaacacaaaatgttgtaaatgcgacacagccgggcctgaaaccaggagcgtgtgatgacctttaatatgatgcctggggtcactggagcgctttatcggcatcctgaccgaagaatttgccggtttcttcccgacctggctggcccctgttcaggttgtggtgatgaatatca

SEQ ID NO: 406 - DNA, 200 bp, synthetic construct
  misc_feature 1..200: note = Synthetic polynucleotide
  misc_feature 1..200: note = PinfC / disrupted nifL gene
  source 1..200: mol_type = other DNA
cggaaaacgagttcaaacggcacgtccgaatcgtatcaatggcgagattcgcgcccaggaagttcgcttaactggtctggaaggtgagcagctgggtattgcaatagaactaactacccgccctgaaggcggtacctgcctgaccctgcgattcccgttatttcattcactgaccggaggcccacgatgacccagcgacc

SEQ ID NO: 407 - DNA, 20 bp, synthetic construct
  misc_feature 1..20: note = Synthetic primer
  source 1..20: mol_type = other DNA
caagaagttcgcctcacagg

SEQ ID NO: 408 - DNA, 20 bp, synthetic construct
  misc_feature 1..20: note = Synthetic primer
  source 1..20: mol_type = other DNA
tgcctcgcaacaatgttcac

SEQ ID NO: 409 - DNA, 20 bp, synthetic construct
  misc_feature 1..20: note = Synthetic primer
  source 1..20: mol_type = other DNA
cgccctcatattgtggggat

SEQ ID NO: 410 - DNA, 19 bp, synthetic construct
  misc_feature 1..19: note = Synthetic primer
  source 1..19: mol_type = other DNA
ggcataacgcacccgttca

SEQ ID NO: 411 - DNA, 15 bp, synthetic construct
  misc_feature 1..15: note = Synthetic probe
  source 1..15: mol_type = other DNA
tctgaagctctcggt

SEQ ID NO: 412 - DNA, 22 bp, synthetic construct
  misc_feature 1..22: note = Synthetic primer
  source 1..22: mol_type = other DNA
taaactggtactgggcgcaact

SEQ ID NO: 413 - DNA, 23 bp, synthetic construct
  misc_feature 1..23: note = Synthetic primer
  source 1..23: mol_type = other DNA
caaatcgaagcgccagacggtat

SEQ ID NO: 414 - DNA, 15 bp, synthetic construct
  misc_feature 1..15: note = Synthetic probe
  source 1..15: mol_type = other DNA
gaccctacgattccc

SEQ ID NO: 415 - DNA, 20 bp, synthetic construct
  misc_feature 1..20: note = Synthetic primer
  source 1..20: mol_type = other DNA
ggtgcactctttgcatggtt

SEQ ID NO: 416 - DNA, 20 bp, synthetic construct
  misc_feature 1..20: note = Synthetic primer
  source 1..20: mol_type = other DNA
gcgcagtctcgtaaattgcc

SEQ ID NO: 417 - DNA, 15 bp, synthetic construct
  misc_feature 1..15: note = Synthetic probe
  source 1..15: mol_type = other DNA
gcgatgaccctgaat

SEQ ID NO: 418 - DNA, 19 bp, synthetic construct
  misc_feature 1..19: note = Synthetic primer
  source 1..19: mol_type = other DNA
ctcggcagcatggacgtaa

SEQ ID NO: 419 - DNA, 21 bp, synthetic construct
  misc_feature 1..21: note = Synthetic primer
  source 1..21: mol_type = other DNA
agggtgttaaacagcgggaaa

SEQ ID NO: 420 - DNA, 15 bp, synthetic construct
  misc_feature 1..15: note = Synthetic probe
  source 1..15: mol_type = other DNA
tccgaatcgtatcaa

SEQ ID NO: 421 - DNA, 20 bp, synthetic construct
  misc_feature 1..20: note = Synthetic primer
  source 1..20: mol_type = other DNA
gagccgttctggctgcatag

SEQ ID NO: 422 - DNA, 18 bp, synthetic construct
  misc_feature 1..18: note = Synthetic primer
  source 1..18: mol_type = other DNA
gccgtcggctgatagagg

SEQ ID NO: 423 - DNA, 15 bp, synthetic construct
  misc_feature 1..15: note = Synthetic probe
  source 1..15: mol_type = other DNA
tgaagcacctgatca

SEQ ID NO: 424 - DNA, 20 bp, synthetic construct
  misc_feature 1..20: note = Synthetic primer
  source 1..20: mol_type = other DNA
ggaaaacgagttcaaccggc

SEQ ID NO: 425 - DNA, 20 bp, synthetic construct
  misc_feature 1..20: note = Synthetic primer
  source 1..20: mol_type = other DNA
gggcggaccgagagatctaa

SEQ ID NO: 426 - DNA, 100 bp, synthetic construct
  misc_feature 1..100: note = Synthetic polynucleotide
  misc_feature 1..100: note = 100 bp upstream of junction
  source 1..100: mol_type = other DNA
cttcggcggcgtgaagaagagtggttttggtcgcgagctgtcacattttggtctgcacgagttctgtaatgcgcagaccgtctggaaagaccgtcgctaa

SEQ ID NO: 427 - DNA, 100 bp, synthetic construct; identical to SEQ ID NO: 330
  misc_feature 1..100: note = Synthetic polynucleotide
  misc_feature 1..100: note = 100 bp upstream of junction
  source 1..100: mol_type = other DNA

SEQ ID NO: 428 - DNA, 100 bp, synthetic construct; identical to SEQ ID NO: 363
  misc_feature 1..100: note = Synthetic polynucleotide
  misc_feature 1..100: note = 100 bp downstream of junction
  source 1..100: mol_type = other DNA

SEQ ID NO: 429 - DNA, 100 bp, synthetic construct
  misc_feature 1..100: note = Synthetic polynucleotide
  misc_feature 1..100: note = 100 bp downstream of junction
  source 1..100: mol_type = other DNA
atggcggcggtgatcaataacgcaatgctggaagccattctggcagaaatcaggccgctgattggccgcggtaaagtggcggattacattccggcgctgg

SEQ ID NO: 430 - DNA, 200 bp, synthetic construct
  misc_feature 1..200: note = 3' end of Succinate semialdehyde dehydrogenase/Prm1.2
  source 1..200: mol_type = other DNA
cttcggcggcgtgaagaagagtggttttggtcgcgagctgtcacattttggtctgcacgagttctgtaatgcgcagaccgtctggaaagaccgtcgctaagcccgctgaccgaccagaacttccaccttggactcggctatacccttggcgtgacggcgcgcgataactgggactacatccccattccggtgatcttacc

SEQ ID NO: 431 - DNA, 200 bp, synthetic construct
  misc_feature 1..200: note = Prm1.2/glsA2
  source 1..200: mol_type = other DNA
tcactttttagcaaagttgcactggacaaaaggtaccacaattggtgtactgatactcgacacagcattagtgtcgatttttcatataaaggtaattttgatggcggcggtgatcaataacgcaatgctggaagccattctggcagaaatcaggccgctgattggccgcggtaaagtggcggattacattccggcgctgg

SEQ ID NO: 432 - DNA, 1327 bp, synthetic construct
  misc_feature 1..1327: note = glsA2::Prm1.2 ATG-start
  source 1..1327: mol_type = other DNA
gcccgctgaccgaccagaacttccaccttggactcggctatacccttggcgtgacggcgcgcgataactgggactacatccccattccggtgatcttaccattggcgtcaataggttacggtccggcgactttccagatgacctatattcccggcacctacaataacggtaacgtttacttcgcctgggctcgtatacagttttaattcgctaagtcttagcaataaatgagataagcggtgtgtcttgtggaaaaacaaggactaaagcgttacccactaaaaaagatagcgacttttatcactttttagcaaagttgcactggacaaaaggtaccacaattggtgtactgatactcgacacagcattagtgtcgatttttcatataaaggtaattttgatggcggcggtgatcaataacgcaatgctggaagccattctggcagaaatcaggccgctgattggccgcggtaaagtggcggattacattccggcgctggccagcgtcagcggcgataagcttggcattgcgatcagtacggtagacgggcagcacttcgccgccggcgatgcgcatgaacgtttttccatccagtctatctccaaggtattgagcctggtggtggccatgaaccactatcaggaagaggagatctggcagcgggtgggcaaagatccctccggccaaccctttaactcccttttgcagctggagatcgagcagggcaaaccgcgaaacccgtttatcaacgccggggcgctggtggtctgcgacatgctgcagagccggctcagcgccccgcgtcagcggatgctggagattgtccgccgcctgagcggcgtggccgatatcgcctacgatccggtggtggcccgctctgagttcgagcattcggcgcgcaacgccgccatcgcctggctgatgaaatccttcggtaacttccataacgacgtcgccaccgtgctgcagaactatttccactactgttcgctggagatgagctgcgttgagctggcgcgaaccttcctgttcctcgccgatcgcggtatcgccccgcacctggaggcaccggttatcgcgcccattcagtcccgtcaggtgaatgccctgatgatgaccagcggcatgtaccagaacgccggcgaattcgcctggcgcgttggcctgccggcgaaatcgggcgtcggcggcggaattgtggcgattgtgccgcaggagatggcgatcgccgtgtggagcccggagcttgatgacgccgggaactcgctggccggcgtggcgctgctggaaaaactgactcagcggatggggaggtcggtgttctga

SEQ ID NO: 433 - DNA, 2327 bp, synthetic construct
  misc_feature 1..2327: note = glsA2::Prm1.2 ATG-start with 500bp flank
  source 1..2327: mol_type = other DNA
tgggcgacccgcgcgatgagcaaaactacgtcgggccgatggcgcgtttcgacctgcgcgatgaactgcaccagcaggtaacggcgacccttgatgaaggggcaactctgctgctgggcgcagaaaaaatcgaaggagcgggcaactactatgcgccaacggtgctgggcaatgtcaccgccgggatgaccggttttcgtcaggagctgtttggtccggtagcaaccctgaccaccgctcgcgacgctgaccatgcgctggccctcgccaacgacagcgagtttggtttgtctgcaacggtctataccaccgacgaggcgcaggcccagcgcttcgcccgcgagctggagtgcggcggcgtgttcctcaacggctactgcgccagcgacgcccgcgtggccttcggcggcgtgaagaagagtggttttggtcgcgagctgtcacattttggtctgcacgagttctgtaatgcgcagaccgtctggaaagaccgtcgctaagcccgctgaccgaccagaacttccaccttggactcggctatacccttggcgtgacggcgcgcgataactgggactacatccccattccggtgatcttaccattggcgtcaataggttacggtccggcgactttccagatgacctatattcccggcacctacaataacggtaacgtttacttcgcctgggctcgtatacagttttaattcgctaagtcttagcaataaatgagataagcggtgtgtcttgtggaaaaacaaggactaaagcgttacccactaaaaaagatagcgacttttatcactttttagcaaagttgcactggacaaaaggtaccacaattggtgtactgatactcgacacagcattagtgtcgatttttcatataaaggtaattttgatggcggcggtgatcaataacgcaatgctggaagccattctggcagaaatcaggccgctgattggccgcggtaaagtggcggattacattccggcgctggccagcgtcagcggcgataagcttggcattgcgatcagtacggtagacgggcagcacttcgccgccggcgatgcgcatgaacgtttttccatccagtctatctccaaggtattgagcctggtggtggccatgaaccactatcaggaagaggagatctggcagcgggtgggcaaagatccctccggccaaccctttaactcccttttgcagctggagatcgagcagggcaaaccgcgaaacccgtttatcaacgccggggcgctggtggtctgcgacatgctgcagagccggctcagcgccccgcgtcagcggatgctggagattgtccgccgcctgagcggcgtggccgatatcgcctacgatccggtggtggcccgctctgagttcgagcattcggcgcgcaacgccgccatcgcctggctgatgaaatccttcggtaacttccataacgacgtcgccaccgtgctgcagaactatttccactactgttcgctggagatgagctgcgttgagctggcgcgaaccttcctgttcctcgccgatcgcggtatcgccccgcacctggaggcaccggttatcgcgcccattcagtcccgtcaggtgaatgccctgatgatgaccagcggcatgtaccagaacgccggcgaattcgcctggcgcgttggcctgccggcgaaatcgggcgtcggcggcggaattgtggcgattgtgccgcaggagatggcgatcgccgtgtggagcccggagcttgatgacgccgggaactcgctggccggcgtggcgctgctggaaaaactgactcagcggatggggaggtcggtgttctgatggttgagcaggatcggttgtttgcccgtctggcgcgctcgacgtttcgttcacgctttcgactcggggtcaaagagaggcaatactgtctagataaggggccggagatcatcgaccagcacgctgcggattttatccgccagcggctggcgcccgccgaaccgatgaacgacggtaagcagacgccgatgcgcggccatccggtatttatcgcccagcatgcgaccgccacctgctgccgcggctgtctggaaaaatggcacgccattccccacggccgcgcgctgagcgagcaggagcagcgctatgtggtgcaggtgatccatcactggctggtgctgcagatgaacggcccgtctgtgcggtaatctgcatttgatcggcgccggagtatgcctgataaatattctcatgttatgataatccgctaactaattattaacataataattgcctgaaacaattagacggataattactgaatgtcttcactgtcgatt

SEQ ID NO: 434 - protein, 219 aa, Kluyvera intermedia; identical to SEQ ID NO: 127

What is claimed is:

1. A guided microbial remodeling method for the rational improvement of the fitness of genetically modified plant-associated microbes, comprising:
    a. providing a wild type microbe with nitrogen fixing activity, wherein the wild type microbe contains one or more genes for regulating nitrogen fixation or assimilation;
    b. introducing one or more targeted genetic variations within one or more of the genes for regulating nitrogen fixation or assimilation to produce a genetically modified microbe having increased nitrogen fixation activity and decreased fitness compared to the wild type microbe;
    c. introducing one or more targeted genetic variations into one or more genes in a glutamine conversion pathway of the genetically modified microbe to improve the fitness of the genetically modified microbe, wherein a resulting genetically modified microbe has increased nitrogen fixation activity and at least the same fitness of the wild type microbe as compared to the wild type microbe under the same growing conditions.

2. The guided microbial remodeling method of claim 1, wherein the resulting genetically modified microbe has at least the same fitness in a plant's rhizosphere as compared to the wild type microbe.

3. The guided microbial remodeling method of claim 2, wherein the resulting genetically modified microbe has at least the same fitness in the plant's rhizosphere during the plant's growth cycle as compared to the wild type microbe.

4. The guided microbial remodeling method of claim 2, wherein the resulting genetically modified microbe has at least the same fitness in the plant's rhizosphere in fertilized soil as compared to the wild type microbe.

5. The guided microbial remodeling method according to claim 1, wherein the one or more genes for regulating nitrogen fixation or assimilation are selected from the group consisting of: nifA, nifL, ntrB, ntrC, polynucleotide encoding glutamine synthetase, glnA, glnB, glnK, drat, amtB, polynucleotide encoding glutaminase, glnD, glnE, nifJ, nifH, nifD, nifK, nifY, nifE, nifN, nifU, nifS, nifV, nifW, nifZ, nifM, nifF, nifB, nifQ, a gene associated with biosynthesis of a nitrogenase enzyme, and combinations thereof.

6. The guided microbial remodeling method according to claim 1, wherein the one or more genes involved in the glutamine conversion pathway is glsA2.

7. The guided microbial remodeling method according to claim 1, wherein the one or more targeted genetic modifications in step (b) and step (c) are non-intergeneric.

8. The guided microbial remodeling method according to claim 1, wherein the one or more targeted genetic modifications in step (b) and step (c) are selected from the group consisting of: full gene deletions, partial gene deletions, promoter insertions, single base pair changes, and combinations thereof.

9. The method of claim 1, wherein the decreased fitness compared to the wild type microbe is evidenced by decreased colonization potential.

10. The method of claim 1, wherein the at least the same fitness of the wild type microbe as compared to the wild type microbe under the same growing conditions is evidenced by at least the same colonization potential of the wild type microbe as compared to the wild type microbe under the same growing conditions.

* * * * *